United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 55

SEQ ID NO: 825 - DNA, 581663 bp, Homo sapiens
agattctgcatcttttaatgaaagataaaacaacaatataaacatacacaaatttacagagaagggatcaactttaatacatttggagtaaaaggtgtttcttctttaaatatggtataaaaataaatgcgagaaacattaacggagaatgtacagacaacagacgaagacatgagtttgtttctgactgtgacacattggtgaaatgaaactttctgtgcggaatttattgtttaataaatgtgaagccacatgtatacttattgatatatacttttttcttttacagttcttccagtttttgactgactgaattttcagtgaactgtgtgtctaactgaagctttgagagagagagagagagaaagaaggaaaaaaagaaaaggttttacttcacttgaacttgttaaaaaggaagagacacagatccagcatagtagaaggagaaagaaagcagacaacagtttggaatggaggcattgagacggaagagtccattggagatggaatgtacacacaaaaataacaatttaggtcctttgctcatgcaacatcttgttctaatgtcctctgctccaggtcacaacattgagctacaaagtgtgtgcagtgactccagtctgcattcatgctacaagatgatccgtttagtaagactgagcaaggcttgttaacctcttggacgtgagagatttcccctgagaaaatatataaaacaagagaaaagaaagaaaatcaagtacgatcactgaaaacctgcttagtagtagcaactatttactgtagctgatttttgtgcaaggtcaacactgaaccctttaagtccatcttagttcaaacctcatgaccaacctgccttcccccctccctccctccactgacacgtcaaacaaaactatcctccctccctccaccctcctacccctcccaaatccttcctccccactgcaaacagactgatggtttcacagcacagattagcaaatcataaaacatatccataaatgctccatcaaggcttagcaatgaagcaacacctaggttcccaactgattataaacatgttacaacaaatcttagtaagctgctctgaaagataatgtgagtgcattcttgttcaatggctgaaattaatgtcacatttataaatatctagaaatgtagaggatacgatttaattaaataaaatgcagtttttgagggtgtgattcatgaaactcaagattgagtctgttccctatcttacataataatggataaaaaggtgccaattatatatctgaagataaaagtctacttgttccctgtttctagctgttgatgtcttcctgttctttcctacctgacttcttccaaccctaatacaagaaaaaatctgttctattctgattccacaaatcatatgattacataaagcacatacttatgttttagaaatcttgtaagtcaacagtgttgctgttaatcacaagtactctagagagataagaaatttgagaccgggcgcagtggctcacgcctgtaatcccagcattttgggaggctgaggtgggcagatcacctgaggtcaggagttcgagaccagcctggccaacatggtgaaactccgtctctactaaaagtacaaaaataagccaggcgtggtggcgggcacctgtaatcccagctactcaggagaatcacttgaacccaggacgcggaggttgcagtgggctgagatcgcgccactacactccagcctgggtgacaagagcgagactctgtctcaaaaaaaaaaatagaaatttgaaacgtttgatcggaatgcaaaactgctggttttcatttcatgtcttattttatatgttctattataaaattatgtgggccagttatttaatgaatttttgtacatctcagaagataagtaaaaattaaaaaattggaaacatatattttagtaataaatcacagtcatagcaatactcttgatttgctacctaatgtggctcagttttagaaaggggtcagcggtgatgggagatacatcatcactcatggccattgccttagtctgtttgggctgctataacagaaaacgatagactaagtggcttataaacaacagaaatttatttcttataggactgggaagtccaagatctagacacttatagattctttgtctagtgagggccttctccttggttcatcaatggtgcattctcgttgtgtcctcagataatggaagaaggaaataagctccctgggacctatctgataaaggctcctgttcataagggcttcaccttcatgatctaatgaccttccaaaggccctaactcctaataccatcaccttcatgatctaatgaccttccaaaggccctgactcctaataccatcaccttcatgatctaatgaccttccaaaggccctgactcctaataccatcaccttcatgatctaatgaccttccaaaggccctgactcctaataccatcaccttcatgatctaatgaccttccaaaggccctggctcctaataccatcaccttcatgatctaatgaccttccaaaggccctgactcctaataccatcaccttcatgatctaatgaccttccaaaggccctggctcctaataccatcaccttcatgatctaatgaccttccaaaggccctggctcctaataccatcaccttcatgatctaatgaccttccaaaggccctggctcctgataccatcacccttgagattaggatttaacatgtgaacttgagcgggaagggatcacaaatattcagttcatagcagccacatttttggaaaaagacaatatgtttaagaaaagattaataattccataatcaacctgtctttacacaccatataattactgataagggcccttttgctgatatgaacagcagcaatgaaaatcatgcaccattttctcttaattttttcttaattgggaaaaagggtccacaacttagctttcagcatctgagagtagaagatattaaagtggtttttgttttgttttgtttttttgagacggagtctcactccgtcgtcaggctgaagtgcagtggcgaaatctcggctcactgcaacctgcacctcccggattcaagcaatcctcctgcctcagcctccagagtagctgtaactacaggcacctgccaccacgcctggctaatttttgttatttttagtagagatggggtttcaccatgttggccaggatggtctcgatctcttgaccttgtgatccacccgccttggcctcccaaagtgctgggattacaggcacaagccactgcgcccggctgatatcaaagtttaatgctggcatttcccactaggcttatgtttattcactttatgggagaaacaacaataaaagagaaaacagtttattaacaacagaccctgctttataaataaaatatgcactcctgcctgctctggtctgtctgtccccctcaaagctcacatgttgaaagcttactccccagtgtgatgctattaggaggtgggggctttgcgaagtgaccatgtatgagggtgaagctctcattaatgggattagtgttctttgtgtgtgtgtgtgtgtgtgtgtgtgtgtgtgtgtgtgacagtctcactctgttgcccagactggagtgcaatggcgcaatctcgggtcactgcaacctccgcctccaaaggcccctacctttggagggcctcaaattgcttgagttgctgggttcaagcgattctcctacctcagcctcctgagtagctgggattacaggcatgcaccaccacgcccggctaattttgtacttttagtagggccagcttttgccattttggccagcctggtcccaaactcctgacctcaggtgatccacctgccttggcctcccaaagtgctgggataagaggcatgaaccactgcgtcaggcctagtgctcttataaaagaggccgaaggaagcttgtttgcccctcccaccaggtgaggacacagtaggaagatggctgtctatgaaccaggaagggggccctcatcggacactgaatctgccagcatcttgatcttggacttctcagcttctagaactgtgagagataaatttattttgcttataagctacccacccagtttgtggcattttgttatagctgactataacggactgaaatgctgcctccacttctatgcctatttcctcatctgtaaaatgaggataataatagtacttattttcaaattttgttgtgaagaatgatacaagtaaattgcttaaaattatttatggatcattttgtgcactcagtttacgttggctattacctcattatactatcattataattattaacactatcattatatgctctcttcattaagatacccaaacccagagtcactattctgactctaaaaggacagaaagttataaattaaaagctaaaatcatactgcttttccaccccaatcctgggcaataagctaatcaaatgatgttgaaataaaaaagattcagttcttaaatacaatgccatttcctgtgtttactactgtagtctctgtgctatgaatagaattgtatacacatgtgcatatatacctattctgagactgaacaatttatatttaaaaagtgcttacttggctgggcatggtggctcatgcttgtaatcccagctctttgggaggccgaggcgggtggatcacttgaggccaggagttcaagaccagcctggccaacatggtgaaaccccatctcttctaaaaatacaaaaatcagctgggtgtggcggggcacacctgtagtcccagctactcgggaggtgggagaatcatttgaatctgggaggcggaggttgcagtgagccaagataggccactgtactccagcctgggctacagagtgagactctgtctcaaaaaaaaaaaaaaaaaaaaaaaaaagtgcttcctctttgtgggatgaaggaaggtacacatcagtacacgttgttgaggcacaggaatgaattcttatatagtagaagactggggaaagatgctgatataaaactgtttcttttaaaactacagattaatgtgatttggttcaaaattctgggaagaagaatgggccgggcgcggtggctgacgcctgtaatctcagcactttgggagagcaaggcaggtggatcatgaggtcaagagatcgagactatcctggccaacatgttgaaaccccatctctactaaaaatacaaaaattagctgggcgtggtggtgcgtgcctgtagtcccagctactaaggaggccgaggcaggagaatcgcttgaatccgggaggtggaggttgcagtgagtcgagatcgcaccactgcactccaacctgggtgacagagcgagactctgtctcaaaaaaaaaaaaaaaaaaagagtgaaatagttacattgaaattggaagccatttgaaactcagatacagtcatttttttatttgaacaatgacatctactgttgtctttatcaatttataaaaaaaaaaaaacatggttctctttctatggttttgtttttattttttcaaatatcctcaaatcctcaaagctactagtacttggcctgatatggacttcattaaaaattggatgatacaagttaagcccgacaaactcttgtcccaggaaataattaaaaaatactttttcatagcagcccagagagaaatacaggcccacagtaaacctggggctttgtgatattagcataacaatgggcaaaaatgagaaaacatacaggtgtattttaacaacaaaactctgtgtggaccaggcgaggtggctcaggcctgtaacccccgcactttgggaggccaaggctggcggatcacctgaggtcaggagttcgagaccagtctggccaacatggtgaaaccccatctctactaaagatacaaaaattagccaggtgtggtggcaggtgcctgcaatctcaactactcaggaggctgaggcagggagaatcgcttgaacccaggaggcggaggttgcagtgaggtgagattgcgccactgcactcatcctgggtgacagagcgagactctgtctcaacaaacaaacaaacaaaacctctgtgtgtggtatagatttatcaaatgtgcaataaggatatttgttttgtatattgagacaactaaaaggcaaacttgggtacaactaacagttaacagatcttgggctgggtgtggtggcccacgcctgtaatcccagcactttgggaggccgaggcaggtggatcacttgaggtcagaagttcaagaccagcctggttaacatagtgaaaccctgtctctactaaatatacaaaaattagctgggcatggtggcggtcacctgtaatcccagctactcgggaggctgaggcaggagaatcacctgaacctgggaggaggaggttgcagtgagctgagatcgcgccattgtactccagcctgggcaatagagtgagactccgtctcaaaaaaaaaaaaagagatcttaagtgcagcactgaggtcaaagcagacagcatggatgcccaataggccatctggattggaagatttacacttggatctatttgtaaaccatgtgcaaatcctgccttattcacatagtggaaaggaaaatgcataagccctactctagtgcacaaagaaatgattgtgtgtatacttttggttgctcactcctccactgcaatgtattaagttaaaaagaacacgatcacttccagggaagtacacgtggtacggtatttgcatgtcagccattttggaacaatcattttcagtgcagttccttggatgctgtatggaaccagctcctgccaatgatcttttcccaatttttccaaattgaagaatctgagaaatggtttttaaaaactattttttaaatttttcgagacagggtcttgctctatcacccaggtcagagtgcagtggtgtgaccatgacacactgcagcttcgacctcccaggctcaagcgatcctcctgcctcagcctcccgagtaggtgagaccacaggtgtgcaccaccacacctcgctgattttttatttttagtagagatgaggtctcattatgtcatccagtctgatctcaaactcctgggctcaagcgatcctcccagctcagtctcccaaagtgctaggattacaggtatgagacactgtgcccgaccaaatatgagacatttttatagctaagttttaaagtcttaattccagaaatgaaaagggctaacaaaccctatcaatggcacttttaaaaaacgaaattgcttacaataattctatgcgaataatacttatttttaacccaatgattacatatgtgttatgtgatttaaactcttcctgtcagattctaaaggaaacagattatagtggaaacaaatctatagagaaagacaaatatactcagaacataacaaaaactcaagatcctgtgagattttgtaatatctggttaatggaaatatgctagaaaaagcagcatataatcagtttcaggacaaaataaacctgagacttcagctggcacgtaagtgaacagagagcatcatcctagtctataatacaataattacataaacaaagagagttctctagtgtgtcacaataaaacttcccctcaaccaaaccaattcctttctgtcctaaatggtttgcagagattttgttataattagggacaacactctcaaaacaaaaataacaacctatgtatttgtccttaacttttccaagtgagctatcaaaggtataaattttaactgactttaaaaacatcattcttggcctgggcacagtggctcatgcttgtaaacatagtaccttgggagactgaggtggatggatcacttgcagtcatgagtttgagaccagcacggccaacatggcaaaaccccatctctactttaaaaaaaaaaaaaaagcagggcatggtggtgcgtgcctgtaatcccagctacccaggaggctgagacaggagaattgtttgaacccaggagacagaggttgcagtgagccgagattgcgccactgcactccagtctgggtgacggagcgagactctgtctcaaaaaaaataaaaaataaaaaataaaaaaaaatcgttcttggtcttaaagtaataacagaaagttgatggtaaggagccctgagtcagtaggaattgatgaaggccaggctcttagctatagcctgagagcctggggcattagggagatggaagcaacttcctacattcttctcctgcaatcccttcttcacaaaggaaatagagagaagctatgtttgctttagttactaagcccacttattttattgctgtcataaaaacacacagaatggccaggtgcggtgattcatgcctgtaatctcagcactttgggaggccgaggtgggcggatcacctgaggtcaggagtttaagaccagcctggccaacatggtgaaaccctgtctctactaaaaaaaaaaaaaaaaaaaaaaaaatagccgagtatcgtggcaggtgcctgtaatcccagctactcgggaggctgaggcaagataatcacttgaacccgggaggtggaggttgcagtgagccaagattgtgccattgcactgcagcctgggctacaaaagcgaaactctgtctcgaaaaaaaaacaaaaaaacaaaacaaaacaaaaaaacacagtagtcttttctagtatacaggacactgaagagattgagcagaaataaaggggcagatttttaaagggtggctatgaaacagattacagagaagagtagaaagttatcaacatcttttagattttttttgaggccgggtacgatgtctcacgcctgtaatcccagcactctgggaggtagaggcgggcagatcacgaggtcaggagattgagaccatcctggctaacacagtgaaacctcgtctctacaaaaaaaaaatacaaaaagaattagccgggcgtggtggcgggcgcctgtagtcccagctactcaggaggctgaggcaggagaatggcgtgaacccgggaggcggagcttgcagtgaaccaagattgctccactgcgctccagcctgggcaacagaataagactccgcctcaaaaaaaaaaagatttttttttttttgaaaaaaaatttaacctccattttcgctatccttttgcaattcctgcttgtttgtctccagccactgcctccgagtctctcccatatgttgctgtagactgggatggatattcttgagtgccttgtaggctgcagagactatggagaggcactggggataagaaaggtaaaatcttatcgttgcccttccactggtttatgtgatccaactgtctcaccagatgctcaaccccacagctatgttaataaaaagaactgaccatatggtggtaaaatgagatgctattggaccagagatagggaatgtttttaggagagtctgagctaaaggatgttatctgtttattattttactctcatgttgaaaaatgccttttccacttattgaaccagggataggcagtgctcttagcagagtctaaactaagggatgctagatgtttgttattttactctcatgttgaaaattcccgtttcacttataaatataaacatctttgcctggatttccaaatccttcactacctgggttccgtggcctttcagactctttactgttacccacgaagtggttctttggctggcccttgtgcctgctgctctctccgctggtcacctgtttgtgcatgtacctgttcagaccctatccactcttcaaagatgaacttcctatctatgtccttgctaaagctttctaactatccctaaactcctccggttccctctttgaattcttcttgctggtagaacctgcattagcacttttatatgccttcttacgtgattttgtaagtcatctggcctgatgaagtgataacggacagctgttaaacattaatattatagcagtctccaaataagtagttgattatttgcaagagctgagctccttggctgcaaatctcattaagggaataaacttctagaaatcagggtaatgagattccaaggtcttgggaaaattaacttttaatttgggggaggagagacatggtggagagagggatgggggtcactggtcacaccctaaatgttaacagattgactaatagaatcagaatattttcaagtaggcaggtgctaagaaggaattcaagctaggctaggtgttagggaagctcttgcacaatttaaatgaaatcagttcttccaggtaaacttacaagtgagtttgctgaaacatagtgaataatttttataaaactgtggaggtgggtgagttcctagaatgttaaagataagctcgaattcttgagaattaagatggcaaggacaagaggaagaggattctgtagttagttttgaaactgtcatatttaatgttgaatgctgaaaaatattctagtactacgtactaaaaagagatagcttatgaacacatatacatttaagtactggtcactagcttcctaagagaattgagaaagaataagtatagccaaatactttcattttcttaaaatatttttccataataaaaccagtatgtgttcactaaagaaaatgaagaaaacatagaaaaaagagaagaaataaatattacttgaaatatgatcatttacattctattatgtccttctacctttttatacacagatacatgtttaaaattttttttacaaaactgaaattatactgtgcatggtactatgtcatattctgaataacgtgtgtattaaagagattacattttgttcaattacccatgttatggatgtttcttcaaaaataatgttgttttaccaactaaatgcattagttggtaaggaaatcaatttagagagatgcaaccaacatttagaaaaaaattaagtacagaatacattttaaaaatcagattgcattgcacataagggaatgtattgttatttcagttctatgtacatataaacacacacaaatacagtttatacagtaaccatatatatgtacacacacacatatacaaatacgcacaaacacatgtatgtgtcgatcaaatgtggctactctgggcacactgcctatggattagccctgctctgcaaggaacaatagaaaaattaatattttttaaaaaatgtgtcaaatatgggtatcattaaaagaaacaaaagccaatgctttaaaatataatttttaacattcgtataacattccaacagtagatatgtcttgatacagttaagaaattcacaattgttgtactttcagattgtgttctatatttgacaattatataatgcaacaaatattttttatatgtgggaacacctgggttttttttaggattaaactactagaacttgaattactgattcaaagtgagagatttttgaccttctggcacattctgtcaaattctattcgacaaaagtgatagcaattcagacttttatgagcactgtatgagatcacctattttcttaacccctttctgatactagatgttatcatattaacaaaacacatctatttggaggaaaaagtgattgtgctgctttctgaattttacttgggtattaataacaataggttttcttttttgttttctcacatatcaatgtactgtttgtatttcttttgttaaaattgcctaagtccctccctcattcttctaatggtgtgttgctcttacgacattatatgtttgcaaggagctccctgtagaccctgtattacattttggtctgtcatagagatgctcctttattcattttaaaaaggagtttaccagatttgagcacaggaacttgctttaaacaaaagaccttcggctacgtaaggcacgcagcaggatttgcagtatctctgtgattgaaaaagagaaagatgtgcttcataactaaacaaacaatgaccttcaaagtgtgctattagggcagtggaattctgtcttcctccctgttccttatggtattttaatcagtaatttgaaagattaaactgatgaaattctgataaaatgtatgtatgatctacatatgataaccttggtttaaagactgagtaacaaagaaatacttcaaaaaattatgtaaagctttaaaaatgagctataactcacaagataaatttagtggaaagaagggtaaagagccaacatacactaaagtgaataagtaaacaatgaacgaagaaacctagcagcaaaacacaaaattagggacatgtaatctcagcacatgagaaaaaaaatccaatttttaaagtattttattttaagccccaaatgacattacatgttgctctggttgggggaagttgatgcaattttcaggttagattttaaaagttataatatatgctggctgggccatatctcaaatattgtgtttggttacgattacgaggcctattgatgaactggaacacatgtacaaagtgagcaaacagcaggatgaaagaacaggaaattattaaatgggacaacattagaagctcactttcccattttaagtgtcactcagatttaatttgctagcaacatttaagacatctttatcaagtgtttttgtgttcagcttaattttcacagaagtatctttttctttttatactcaaatttcgacaggtttattttaataaagtacttaaatgcagtatgccatatatttaattataaacagctatgggaacaaatggaacaaaacaaacaaaaatggactcttatactatacagttcaatgggtggttgcagaaatgtgaggacctaattggacagcagcatctcagctgtgacatttgtggctcttgacattcactgtggagaaagtgaagagcattggtacatctagggcagtggttttcaaagtgtggtcttaaaatcagcagcatcagcatcactgagaattggttaaacatgaaaacacttgaattggatccatcagaaaatgacttacgtagactttctgaaagatggagtccagcaatctgtgttatcatgagcactccaggtgattctgatgcgtctcaagtgagaactgcggatgtttagtaaggagagatcagctgggaatacttctatttgtgtgatgatttttaaactgtatggttttgggatgcttgtaaccaatgcggagcagagacaaagacagaataattctaatgtaatcagagatgaggttacaaatctgcatttgccaagcccctggtgatttttgaggtatggatagttggactacacttagaaaaataatgaagtaggcagggtgtggtggttcacgcctgtaatcccagcactttgggaggccaaggtgggtggatcacttgaggtcaggcatttgagaccagccttgccaacatggtgaaacctcctctctactaaaaatacaaaaattagccaagtgtggtggcgcattgttgtgggaaatcagggaccctgaatggagggaccggctgaagccatggcagaagaacataaattgtgaagatttcatggacatttattagttccccaaattaatacttttataatttcttatgcctgtctttactgcaatctctgaacataaattgtgaagatttcatggacacttaccacttccccaatcaatacccttgtgatttcctatgcctgtctttactttaatctcttaatcccgtcatcttcataagctgaggaggatgtatgtcgcctcaggaccatgtgatgattgcgttaactgtacaaattgttgtagagcatgtgtgtttgaacaatatgaaatctgggcaccttgagaaaagaacaggataacagcaatgttcagggaacaagagagatcaccttaaactctgactgctggtgagccaggcagaacagagccatatttctcttctttcaaaagcaaatgggagaaatatcgctgaattctttttctcagcaaggaacatccctgagaaacagaatgtgtccctgaggggaggcctctgaaatggccgctttggggatggctatcttttacggtcgtagctgtgggatgaaataagccctggtctcctgtagcgctcccaggcttattaggatgaggaaattactgcctaataaattttggtcagaccagttgtctgctctcaaaccctgtttcctgataagatgttatcagtgacaatgcctgcccaaaacttcattagcaattttaatttcaccccggtcctgtggtcctgtgatctcgccctgcctccatttaccttgtgatatcttattaccttgtgaagcatgtgatctctgtgacccacaccctattcatacactccctccccttttgaaaatcactaataaaaacttgctggttttgcggcttgtggggcatcacggaacctgccgacatgtgatatctcccccagtcacccagctttaaaatttctctcttttgtactctgtccctttatttctcagaccagctgacacttagggaaaatagaaaagaacctatgtgaaatatcgggggtgaatttcgcccaatagcgcatgcctgtaatccaagctatttgggaggctgaagcaggagaatcacttcagctggggaggtggaagttgcagggagccgaaatcacgccactgcactccatcctgggtaacagactgagactctgtctcaaaaaacaaaaacaaaacaaaacaaaacaaaaacaaaaaggaaagaaataaaaaaataaaatgaagtagagttttctttttttaatttataaatttgttttttatagagaccagatctattttgttgcccaggctgatcttgaactcctggccttaagtgatccccacaaccccttgcctcagcctcccaaagtgctgggattacaggcacaagccactgtgcccagccaatgtagagattttaactaagggaaagaaaaagaaaacttgagggaggtgatgtaaatcacaccttcaagcaattcactagttgtcatctagaggaagtgcttgtattactctgcagtggcttcaggaaatagaactaggattaatagctggaagttacagaaaagtggattagggaagggatttctaagagatggaatggtctgctgtctacgggtaccacatctcagatactcaggagctgccaaatgctgaatacccatttgtcactgagcctacagaaaagattcttgcaatgggctggggattggacccagggaaatagggacctctaagttcctttcaattctgaaactgcaaaaattttatcattccccagatctcctgaaagtaccttgaagatttacattttataatcagaaaagagaaagctctcccaataatcttttctatctcatgttaggaatatattcttgttagatattaatatgcctatttcaggtgaacagtgttgataatagggacttgtttttctcctttgtagtaactgagcccatgtctattgggtaatttggctgatgaaatagatgaaaaacttctttaataccaaaataaaatctgcatgactcaaagaggcaaaaaactgatgatgaactttttttcccccaggaataatagagcattctagagaatgtgctttaaatttccaacaactgccacagcctattttagtaatggcttctgctggttgaaattacaggaataagtggtgtatttaggattgtccaatgtgtgttcctattattattaggtactggccattgacaaaaacaatgacaacagccatcaaaatatggtgcacaatgaagagggcaggagattttgcccaatctgggcttgtgtacagtatcagccaaaaacatacgaaaaatttaccaaggtgtctgtagatatacacataatatatccatgcttatagatggatgcaatttagataaagatgtctaatgtattgctattttaaattgtctattttagtgtcattgctttctgggtactagcaaaaattatggaaaagaaaaaattacaaccacagcttgtcatcagtataaaaatggctttcttttctgaaagaggtttcataaaagaatgctaatgagtatatatgaagctacatgtgtctttagactaagcaagagaaaaggattttgaaagagatgacttgttgatgacccagggctgtctagtaagtggcctcacaactagaaataattaacatatgactccacttttggtggaaattaaatttggacaccataataaacccaaactttacatcaacaacttccattcatctttttcctagatacttaaaacaaatttataaaaataatgtgcaaatattaccctttagaccgttgatggaattctgcttaactctttttcattctatttgatgctgtttaattcaatgacataaattgagattgagagttgaccatctgcaaggtactgtgccaaatgttgaaatgctaagattacattacatagaagatataagtcctatatctccttgctttactgagctacaattttgtaccataatatgagattcagatcattttgaataataattcaagttcaaatatcaccaaataaaataaaagtgataatgcaacataatgagctaatggtcatatataacatgattttaaagtgagacagtgtgacatttatttttctgctgtcaagtcttccagtaaacttggttcaaaaatgttctaaaaagtttattggtgctacaagtcttcttcttccttcatttcttctattttgccacccaagtttttgttatcatctaatgtgcagatgactacagtagctgctgatgctgcaaacacatcctcctatctctagattctcctagcttgccctcatctgctgtgtagatgatgatggcccacgtgtagatccagagcacaggatatgttcttgattaccttcttctgtactctgcttctctcactggaaacctccacagtagtccctgcccgaatttgccttcttcagaccctctttcttgtgccacctttgctctgtctctctctctcctgcagggccccactgtttagcaggcaggtctcttgctaggccttaactcttcctctccctgcctactctgcactgttttaagagaagctatcatgatttatattaaggaagttcgtggaaagccaaatctgttcactgaacagttaacttgcatgagcagaatgaaccaactcaggtgcaactgttagtagtatctccaaagtagtaatttgtgttcatatctgtccttttgcaaagtataagcttcctatgagcagaggctttgtcttatctatccattctcagaacaaattgcctggcccacagtaggttcccaataactgttttgttgttgttgttggatataagaatctagtagtgcttgaatacatgggtgctcttggtttgtaaacttatcatacagagcccccaggatggtctctggctgaagcctcatagctactggcataaacccaagacttcatattcattggaacacaatactttgggaaatgctgtagaaacttctgcccctggcatatgtagcagcaggggtgacatttcccactgtggggagtgtctactcagcagccccacagcattccttaggaacccccagggctgtatcggacactctgacaaaaacccatgatacaattcagagctcacagaacttgagcagcaacttaagaactaacgatgctgccaggggaaaatgaagatatattgtctgaactcaattaggctacaaggtctgatacattgcacaccaatcgatttacatcatgctgcagggaaactaaaattgttttctcaggcaagttatcatcaccgccagtttcaataaaataagatggatagccatatctgccaactacaaaatgacaaatgagatggtttcaggtccacagcagaagaaagacgagaaaatagttcatctttgagcagacacatttcatatgcttgctggtaatatctatggtggggaaactcaatggtcagtttataaattattttcactgaaggtgtagtaggaatatatatatatatatatatatatattttttttttttttttgagacagagtcttgcactgtcgcccaggctggagggcagtggcatgatcttggctcactgcaagctccaccttcccggttcacgccattctcctgcctcagcctcccgagtagctgggactacaggtgtccgccaccatggccagttaatttttttttgtattgttagtagagacggggtttcaccgtgttagccaggatggtctcgatctcctgaccttgtgatcagtccgcctcagcctcccaaagtgctgggattacaggcgtgagccaccgtgcccagccatagtaggaatttttaagcgtagtttacctatattagtgtatctataatcccaagcaacagaatccatagcactcaaccctaaaataatatgcacaaaggctttctttaaggtaaattcacagggcagagatgtaaaatcaaaaccttccttctcgtaggttccaagtctgcttgtgtcctatgatgagtgttttgtgaagcagataatctgcctcattatgatgggtgtttgtgtcagttgaggatctgactcactctgtggagctcttaccatgcctacaacttcattaatatatatataatctagaaaaagaactttctgaatactctaaggcttgtctctactttattgtggtagagattgatatcaagggaagtgaaagtaaggacagccaagctgtcttttttaaccacaaagagtatcacataacctgacacttagtcaaaacttactacctgttgatgaatgaatgatttagaaactagaataatggtatataaaaacaatgatatcaatgtagcagatgcgtggatcccaggccaccaggtcaattttctctgttgggattatttatggggaacaaatccaatggcaagtttatatgttttctttttatttgtcctaggaccctttccaaaatagcctatttacactaatgtgcatgtaggtccaatcagtaaagtccagagtgttcagccaggagggacatgactcaatcccgaacagaaccaaggtccatcccaaacgtgccaggaatgggcagctgagggactgcccaagtagatttgacactgtactgcactgctcctaccctggctccatagctgggctggggctgtgattcccagacgtggcacctgtattattcacaggtttacactgtatgcagaggggagttcccagattatagttttatacgttttataggttattagaatatggagggaaatctcacactagattttacatttaataaaatccaggtaaggctgggcgtggtggctcatgcttgtaatcccagcactttgggaggccgaggcaggcggatcacctgaggtcgggagttcgagaccagcctgaccaccatggagaaaccccgtctctactaaaaatacaaaaaaattagctgggcctggtggcacatgcctgtaatcccagttatttggaggctgaggcaggagaatcgcttgaacctgggaggcggaggttgcagtgagccgagatcacaccattgccctccagcctggacaacaagagcaaaactctgtctcaaacaaacaaataaacaaaaaaacccaccaccaccaacaaaaatcaaaccaagttaaaaatcatttgaccagggactaaaaagtatccttcaagttttcaacagtgtcttaaaaaaaacaatatgtttcccggaaagtagctacagttcttcactgactgaagactaattggtggtggaggtctgtcattaatgtgtaacacactggttttggaaatcaggaatacaacatctgattcccaccttccagaataagttatttttccctctagtgtatgctcttgcatgaaggaaaaaataaagatacaaaagagataaaaagagataaatggatacctcttcccttgtaaatttacattccatttaaccaagcagttcaattttttatgaaaagaaaatcaatatataactttgattttattgtactttgacctataaaagcaatgaataataaataagcaacaacccaaacgtccattaatagatgatcagaaaaattacagggcatatccattcaaaagaattttgcatggttaataaatagaatcatgtagaaaaatagtcaattatttggaagacatttacaatgcattttaagtgaataaagaatgtttcaaaagaatatttaaatataattcaaattcttaagtatttatatttatttgtgcaaaatgctaattggagctgtgtctgggtagagagggtcatctagaggtgaagaaactgaggttcagcagtttaaatgattttttcttttattgttattataattattattatttttgcagagacggggtcttgccatgttgcccaggtggttcttgaactcttggcctagagccacgttcccgcctcagccccacaaagtgctgagattacaggcatgagccactgcacccggccttaaatgattttttaaaattcacatggctagaatatataggactaggtttcaaacctaaatagaaacacatcaaattccttggcccaggctctttttaccatgttaccacttatatataatctgcataaggctgtattaaccagtaattccacagtgggcttagataaatcatttaattttatttaatcaaaataacattctaaaggaactaagtgttgtatcttctttgttttctatttcaaataagaggatttacatttacatttgctcctatcaacatttaaacaattgagttacagagttaaaaacagatttcggctgggcacagtggctcacacctgtaatcccagtagtttgggaagctgaggtgggcagatcacttgaggtcaggagtccaagaccagcctgcccaacatggtgaaaccccatctctactaaaatacaaaaaattagccgggagtgttggcgggtgcctgtagtcccagctacttaggaggttgaggcaggagaattgtttgaaccatggaggtagaggttgcagtgagccgagatcgtgccactgcactgcagcttgggtgacagagtgaaattgtgtctcaacaacaacaacaataacaacaaacagatttgatcctaaagatcaactgatttcagggccaacccactcctgttaaatttctctcacggagtctccacaacttctggtcattccttgcagtccccagagcacagttaggagctcaatccaccagcacaaatacaccaggacagagagaacgggatagccaaggaggcatcatcttttttctattgattcttttaaagtctctacagataattgtcttcattaagatagagtgaaaatattttcaaaaagagataagattaggtgactccctgggtgttcaacatcaatactttctaatattcatttttacttttctacttttgtagcccagagccaggctgatttaatttccacttcacacaaagacaaaaccagtgtgttacacattaatgacagacctccacaaccaattagtcttcagtcagtgaagaactgtagctactttccgggaaactgatattgttcacacaaagacaagacagaaggtgagtcacacagctggcacttgattatgaatcttgattgaaggtgtggctgatcagtcatcctaccctgtttttcctttgttttctatctgtccctccttaatgtttgcatagcagacagatgctatggtttttcttatcttatcatgttatcttttcttattttttcagacagagtttctcttttgtcacccaggttggagtgcaatggcatgatctctgctcactgcaacatctgcctcctgagttcaagcaattttcctgcctcagtatcccaagtagctgggattacaggtgtgcaccaccacgcccggctaatttttgtatttttagtagagacaggctttcaccatgttggccaggctggtcttgaactcctgacctcaggtgatccacccgcctcggcctctcaaagtgctgggattacaggcatgagccaccatgcccagcagatgctatgatattttaatggctgaaaaagtggtgtcagatttgatgatggtgatgaagaaaataattttcataattcttaaagcatatgaacctttttgaaagagaataaagtcaacttaataacatttaaaggtatgagaggacatagtaacccttggaagaccaaccttaagagacttctctgatagcaagaaaaataaagaaataaaagagtaaacaagacatgaaaaggagctttcttgagacaacaaaccccaatgcgggcattacacaaatgtgagttatttttctcctacccattttgggattaatgaaaagaataagaataatctatgaagagtaatgaatttaaagtaaaagaaaaagcttgcttcgagttccagctctaatgctcaacagctggaagatattggtgaaggtgccctcacctcactatttccccatttttttgtctgtgaaaaaaggtgatacctgcctgactacctcccaggattgttgtgcatgcaaacaatgaccaaaacaacaacaaaacacacaaaaaggagtctatattttttggaaaattgaaagtgcaatgcaatcctcagctgtttattataatttttctctaaagtgctagtaagtatttatgaatctgggtaactaacaaaaactcccctgcaaaagctggctagcaaaatatttttgtctctggggtgaaacaaaaacaacaatgccatttttctaaccttggttataaaaaccctaggctggaacatgtaaatcaacttacaaaaataggcacgcattggaaatggactcagactggggaggtgggtatcatcaggtggcaaggtttatttattttttgtcagttgggagaatgtcaaagagcagggtggatccgtggaaatagcactggggaacaaaatacatttggagtcagtcccagctccttccctaactatgtgactctgggcaaattatgcacctcctttgaccctttaaatttcttacctacaaaatgggtaaaataatggctataataatatctaccttacagggccagcatatggattaaattagataatattataaagcgcccagtgcagagcctggtacatggcagatattcaatgaatgtgagtttttccccattattttcctagactacatatttgtttactattttcccctattccatttctttcttggatactgttgaccttgtagcctccctgtatgtaccagagcaacctgtgtagaggattcctttaaaatatttacataaattccatctttactccagtaagtctatctgattataataaaatcactcattctttatcttccattaaattattttattgatcctataaaggtgtctcataaaatttagtatgtaaagatctaagatgcttgatacagctgccgaccatgaagttataaaatacggaacactaaaccaaggggaaattcagagaaccttttaatttccttactccatttcttcagaataacacccaaataaaggtattaaataaaaaagattgcattttattttcctggatggaaaaggattaacactaagcaacagtgtctgaaagttattattatggtttgtgtgtgtgtgtgtgtgtgtgtgtgtctatgtttgtgtgtgtgtgtgtgtgtgtgtgtggatggtattcaacttcttttccttcagtaattccagttgttttttttttttccacttctctttaagaaggtggttgctcttcttggtctagtgaaatcctgcaaattcagttaaatgtaacttctgggatttctcagattacatatgggccctccctcctcaccctaacacccagtagaaattgtttatctttcccttgtacatcctaacattttgtctataccattgggtacctttgagatcaagctctaccatggatatccaaccttttggcttccctaggccacattgcaagaagaattatcttgggccacacataaaatacactaacactaatgacgaataatcttaaaaaaaaggtctgtgcataatttttataacatctaccaccacagataagcaaaaatgtccttgcattcaaagggttggacatggctgcaagtctatactttctacatggtcccaagacatagcacatggtttagaatagaggtggcaattgtgtgaattttgattgaaggtgtggatgatcagtcctcccttccccttgtttcctgttggccctttcttaaagtttgcagtgtgtgaccatatggtactattttaagagtttgagaagtgggttagatatgatgttggaagaaggacaaccatttgacttcccctttccatcttccccaggttacatcactattttaaattatatcacagaaatttccattgtaatttcaagaacagtatattctgtcagcattacgtttgaaaaggattaacttgaaatgcttcttaaacaatacacagagtacctcacattatctgatagtcactttctccagcaaaatcttggagaattgtttgacattgtctttattgccccatggtgacttatgaggcatgcttcagaaaattctgtattaaagaacagaggttccaatagtgccagccaaaatttcataaaatttatttacaatgtgattaattcctggagtccatcattctccatccctttaattcatgcaatcacattgaatgttcacagtatatattactgttcaaattctttcaaatactctgtgtaccgttgcaatggtaattcacaagtagaaatgagtaacattccccaccacaaggatccttgaaggaaactgaaaacaaaagccattatctttgttgaatccagtttgctcacatttcaacacacataactccactgaactggccatcacagcaaaagccacaacacacacacacacagcagcatggagctaaaccacacaactcaacagacaatgcagacaaacttgagtataaaccaagatttttctacctcttttcataacaggttagtgctggccctcagtgttggtgtacagtttttatggcatgggaaaatagggatgtttctgccctataaaaataaatgtgttgaaggctttagtttgagcttacacaatgtcagaaagttccaaaggcactggcacaatacaaaaaaaagaatcttacaaacaaatatatatcatcaaaacacatggcaagatactaagaaaacactggtaggaaaactactggtttctcaggtgatttatgcaacagttttcaacaccttcctgaaaaataaggaataagaaaggcaggctagtgggtctctggtggggcatatcttgtcaccaaccaccactcatataaaatctttaattttaaactgctcagtagatcattttctctctgcagaagtaaaacgcatagaaccctcattgttcttaacattttaagcctcaggaagggctaagggaaagagcatagaaatacatgcactatctttaataaagaaaggaatacaaggaataaaaataaaatataaagaataattattattccttccttttatatgttgtaatataaacttctttccaaactttaattctgtacagataacttgttcatatataacatctttttctactttggaaagggatgggacagaaagataagcagaaaacatgaagttctgaatttgaataaaagaaacacttttgctgttatatcaagaatgcaaggtgggtaacagggctagaaatagggaaattggaaaaatttcattggacttaatgattcataattcctcaaaaaattaaacttaccacattctgtgcaaatttttcaaaagatgttctgcgatccattgagtttccagacttacgtatgtggggtaggataggatgaagggaaataagggaagattaaaaaaaagaaagaaagcaaggaaaacagagcagaaaaagacaggataatgaaatgatgcaacaccaaatccatgttctaaatcagaaggcccatagaggttggagagccgccaagggaggcttcttctcacaggacatgggctctgcttacaccaaaaactttccttgtacaaacaaaatggtgtgattcaagcaaaatcaaattcagccaaaataaagtggatatgtgaagcctttatactgacatttgcagagcctaaatatttaaaaatctagcagcatatcctcagaatttcctcaaaacttttatgagaaaaaattcctattgacaacatcattaattccatagagcattaatgtctaatagaactttccaaaaggatggaaatctcattctatgctgtccaatacagaagcccctagctgtggttactgagcacttgaaatttggctagaatgttatataattttaattaactaatatttaaacagtcccacgtggctagtgactgctgtactggatagtgttactacaaagtatccatttctagttgtaaaggcaatggacttttaaaaatcttattagcctacatgacgatcatgaactacacaaaattataatttaaactcagagtttcaagaagctatgaactattttaacattaaaaagaatgaatgacgttgatgtttatgtccagattttctcttccctgttatattgattacataaggagttatgaacagagagacattgattattaacattgttgaataatgaggtctactacaatacccccataatgtgcttggctaccatgctaggtgtataaaattcatcacagggatattaagtgattcaggataaatgccaaataaaaatattcggaagcaaacattccgacattttgtcatctattattgaaaaaggtgagtctactttcagttatgaggcctgtggttcaaaacatacattctagcttactaaacaaagaaacctctcttcaagtttttgacctaatgactttgttactttcttttctttattgtaattttgattccatgaaactaggcatacagaagactaacatgaaacatgaaaacagcttctaataaattttgcaaagcatgaacatctgcagaaacaaacaaacagaaagtaatacaataagcaataaacaaacagaaacaacttaaatggcccttataaaatgcaaaggtttgggggagggtcttggagtatgttcacttaccattagtccaataccctggattcagcagaggtaattactccaaataattataactgagaactaggccaagaaaaaacaactcacaaaaaaccagtacctttttctttgcctgtagaagctcctgataggcactggatcttataaaacgtgggtatgaatcacttttcatcagtttgtaaatgtgctcctaaaaagaaataatggttgaggtgcttctttatgatttcttgggaaaagtaaaatatcatgatgtcacacatggctaaagaacaaatctagtagcagcgaaaaatagtaataacaatgctgattagaataccttctatttacaggatatttagatcttcaaattcattatctcattcatagatcattgtttaaattggtttaggagctactgaggaggcaaatcacatccagtcattacaaaaatggaatttgattaataaaatgtcataaaattacctcaaatcaagttgttgacttatatagatcactagagaatataactaaatttgctgtctcttaaaactactccaggcctgaagtgggtaatgttgactcagactgagtaatcatcctggatacctttggcctctacatttactgggagggtgccaactacccagaagaatcaaatcatctctttggtacaaattgcatggaaaattgtcttccatacccactttgggtcagagcacaagtccaaaaataaattttgtgatatttaattgctaaatctccaaatttgtgtgctctttcttattacttacccagtgacagattaggtaaatagttgatcatttgcccctaagaagtttgcaatattctgttttgatgatgaattttgatagacaagtcaaaaaaaaaaaaggaaaaaggtactcattcaattcaatctagacccaatctagggaggttccactctggtctaccgcagctcagggagctaacatgtgccttgatcttccaactctagtgaaatatcagttaggtgtagagcttggaactattggagagcattctgaatgttccagttttcttttctttctttttttttttcttgaagaaaatagatgtttcaagaaatgactccagttctctggtcttaaacacaacagcaataatttgaagttactttaaattcatttaaagacattcaggattaaatctcaagacttagcccaatggtgatcttcaaaggatgttaagtttggaactgtatgggaatttgtttgaaaagtagagcaatggctggttttggagttaagcattttgagattcacattctaccttgctcaagaactaccacttacaaatgggataaatataggccaactttttcatctctctgatccttaattttctcatctataaaatagcattgttgtgatgattaaaggaataataaatgtgtagcaaagcatggggtgtggatagtaagtgctcaaatatacttgggtatatggcaggtactcttttaagtgctttcctgtattagttaatataagccttacaaaacccctatggggttggtaaccattatgtccattttacaggtgaagaaactgaggcgtggagaagtggtcacagagcagagctgaaatcagaacccaggcaatttaccttacgatcagattttttttaaaaaccacaaaaaaaactagaattaaatatctgagcttaactgaaaaagaaatctagggccaagtggtattgttttctatagaatttttttttctgtaagaaaagaggatcctcttaggcaagaatatttttaaatgacaccgataactaaaaaaaattctattttaaacctcaggaagggcattccaaacattttccacattgttggctctagaaagatgctcggcattttatcttggactgaaagaaagaaaaatcagcagagaagtgagcagcagggccagagtttctggcctgctctctgtcctgtgtctctctagagtgtaattatttctacattggagaccatggctgaaccacatgggataggtatccagttagctgttaaaattcatgttagtttactacacagttgctgatttctttaaatgaaagccaaggagaaatatattttctatagagagtggaaataaggaaggatattcgtgtatctcattcttcatcttctatattttattttagtaatgtgtgttttttaaaaggtactttttagaattaatattcttctccaaaagaagtttaagaagttatgaagtatgcacgttctgatttaaaaaccaacttcaacacatcattagggagtgggtgcagtggcttatgcctgtaatcccagcactctgagaggctaaggtgggaggattgcttgagcccaggagttggagaccagcctgggcaacatagggagacccaccctgtctctacaaaaaaaaataaaaaaaaattagccaggcatggtggtgcatgcctatggtcccagctacttgggaggctgaggtaggaggattgcttaagcctgggaggccaaggctatagcgagccatgatcatgccactgtaggtaacagagagagaacttgtttccaaaaataaaataaaataaaataaaataccacattattaggaaacactatcccctcattacaagtttatttttcttcttaagtttcaacattttttgagagaaggcagaaattcaagttgtttctacaaagggaattaagatccagtttgagaaaagatgactgaaaatttgccttaggaagttagaatcagttttccttattttttctttctgtaggctaaaaaattaacttgaaaatttaagaaatgtcagaatctaatgtttgattttttttttcaccagagataaaactggtttgagtttgacataactttaagctaattcagtttgaataatttataataatgaataattcaggaatgtcagagtcttagaatgtctacattgaagatgccttaaagattttaaatctttttaaaaaaatgttttaaaaaatcttttactgaggtggggtcatcattagatggtgtttgctcacttactggggggacaaacagagtagaaaatgaagtaaaagttgtaaaatatttcaaatatgccccttcatataaaaatattcaaacttagaaaatattcccaggttttaaaaaaactattcagtttaatgtgtctttgttccttcctagatcagttagagttattttacagttatctaaattgaaaatgttagaaatagctgccatttagaatgaaaataaaatgaatacatctaacgctcaacttctcggaagcacgtttgtggtgtgaggctcaccgtacacccacctgagcatcttcaaatgtgtatcgtccaggttccttcacgttctgtgtggttttgtcataactcttggaatccaagttaatagcactgggggctccgggagccagaaactcttgccatatttcctgaactcttgagggtacttctttaataggcctctttttcaggtcctccactgccagccagaatctatgcagaatgtgagatcgggtgtttactctgatggcccatcatctgaaaattcttgtgacatttacggatcatgcagttcatcatgacgactcacagccagctcactttctctgagggcttccagtatcagggtggtactgactgtgttcaaaggataatcttctttggaagattattatgaaaaataattattaataaaaatataaaaatattaataaaaatattttaaaaatataaataaaaaatattaataaaaatataaagaaacatgaaaaactctctcttctaagtgtttgttgttaaaagcagatctgtcagagccccgtataacactgattttacctaaggaaagtagcacttctgactgttgattgaaaacaaagaggagtttgaagggaattaaaggtgtgggacatggagcctccaattgggagataaagctgtgcattacactgtgttctttggatgttctgtccatttcagcaatgggggctagtatggagagccttttctgttctaggtggtaagggaattacaaagaagctttgctggagttaaaagaggcctggacataagatcagaaaatgctctggctggaaaaataaaaacaattaactaatgttaaggtaatttaattgagagagttatggaatgaccaaagcagcaagctttcacatggaattatttgaaaagttgaaatgtgtagaggcatcattgcaattcagaagccacggaataatatatactgacttacttctgaagatagacttatttataccatatgtatactgaaagaacctgggagtgtgttttggttgataatagcaagtggtaaagtctagtgagaaggggccacattgtattaatcggttgcatttcttcaatattttgctctaggctagagcttgctggttagatctctagaaataatgtttaaaagataaatgagtatatcataatttgttaatagaaacaaacactctactagaaaaaggagctgctaggactgtgttatcctccataaacactcttactgctctaatagtagacgaagtcaaagaaaggcaaagagggccacagagacagcaaacttcaggctacagagtcttaagagaggcacaggtgatcagcagtaccttcgtaactactaagctttaacttgaccattaataaataatcagaaatcagtaatgaagtgcatgagctagaattagaatatcaactactactcagtctagtgatttttgagttttcatttccagattttgtttttttatagatatatgtagcagaggataatctaagtttgacaacgcctcaaacaggaaactaccaccatgacttttagaaaggaaggctcaagacctttccctcttaaaacacagatttagacactgtgcactctaataggaatactatgcgaggctgggcatggtggctcacgtctgtaatcccagcactttgggaggctgaggcgggcagataacctgaggtcgggagtttgagatcagcctggccaacatggtgaaaccccatctctactaataatacaaaaattagctgggtgtggtggcgaatgcccataatcccagctactcgggaggctgaggcacgagaatcgcttgaacccggaaagtggaggttgcagtgagcagagatcatgccattgcactctagcctgggcaacaagagcaaaacttcatctcaaaaaaaaaaaaaaaaaaagggaatactacgcataatccgagggagcagaagtgttgaaattaacatatgctcaggcaagttcatgccagcacactctgaacacatcaatcaaaacagtctctgtcctcaaagaatgagtagagaaaaagataaaccatttaattggccgtaacaccaggaagtacatgaatggctctctaggaagagaacgaactagacggtctgggaaaggcaagcaggaaagagcccctctgctggggcaagtgctggattggaaaagggggatctagacaaagctattctaaatccagtgacatctgaaatgggcctggaaataagcataaaatataaaggggttgagaagttaataaccacacctacactgttatgtaagtgcaggcactgctctaagtgattcacctatattaactcatttaattcccacagtaattctattaggcaagttctattatttccctcattttagagaagaggaaactaagcatatgaagattaagttgcttatttaaggttgctcactattactgtcacagctgaggtttgctcccagaagatctgcagcagatgacatgctcacaaccactccctcacacggtctttctaacagcatcattgcctttcttattctcaccattactgtaattattgtaatagcttaatagcatggaggagccaggtgcaatggcttgcacctgtggtcctagctactcaggaggctgaggtgggaggatcagttgagcccaggatttcaaggctgctatgagctatgacagtgtctctgaactgcagcctgggtgtcagagaaagatcccatctctcttaaaaaaaaaaaaaaatcctatatcctttatataggtggaagctaagtaagtatttttaatgtctttgattcttgatttcctcatcagtaaaatgggatgataacgcctatttcactgggtttccactggattaattggtttccattggattagttgattaaattaattccgttaatgtatactaatgatataaattatatagaaggcactgaaaagtacttggcatatttttagtcactcaaagataaaaactcatgatattactatgttttcttagcacttgctctatgctatgtgttttgctcaaaaaaaagaatgagggaaatacatcataaaatttcaagtttctgctctctattagggagagcagagggtatatttgaagcataagtagttatcgagaaacagtgcttcttatttttttcctgtcctaatatttgaaaaaaaatgctcagacgagtgacacactcactgatagcaggagggcagctgtttaggtaagatgcacggagagttattttattttaagtgcaattcacagccctgttgaccactggaccattttgtctccttcagtgtgtgacacagatatgtcagtggaagcagagtagggctcagatttggggagcagtggacagtagcttggtactggtttgtaggaaaccaagaatgccacttacatgcaatctgacctccttagccacactttctcggcttaaccttcctcagccacgcttttctcatctataaaatgaggcaatatttacattttatgttgttttggtggttggatgtgtgatgatcagaaataatgaatgcaaaatataacagcatacttataaaagtagtagatataaaatatattctggtgtcttgtaggtattcaagaattaatctacatctttcatttatctactgatctatacttactaaggaaacatatgataggcaatatagtagatactcaagaaatatatgtatatgtgtgtatgtatataatgtgtgtgtatatatataagataatctaatatttcttagatataatcacttagcctagagtctagtacggcatagaatgattaagatatgaaatgattaaagcttgaactaagaaattggcaggaattcaattcatgcctgaaacctagtatgcacatgctatcctctttttccaaaggcatcttctctcttcctgttttgatggtttatctcctccccattgtccagctcttagcctagaagcgatttcccctagtatcccttcgctgatctctaactctgggctaggcatccctctctgcttctcccaactaaacacccatgattttgtgctgtgatttgttttcttgtctgtatctaccaatagactgtaattttaatgagagaaggcgatgtttttatttggctaggtgaggctggtaaggcttattacttatttatttactcatgatgatacaaatgatatcagcatgttttcaaaaacttagagaatgagaggaatgtccatctccctagccactaaaatgcctcaaggatcctttatctctgctttatttttaatgcattctttttttttttttttttttgagacagagtcttgctctgttgcccaggctggagtgcagtggtgcaatctcagctcactgcaacctccacctcctgggtttaagcgattctcattcctcagcctccccagtagctggcactacaggcatgtgccaccatgcccggttaattttaattttaattttttgtagagatggagtttgccatgttggccaggctgctctcaaattcctggcctcaagagagccacctgcctcggctcccaaagtgctgggattataggcgtgagccctcgcacctagccttttaatgaattcttgcactcaattattgacaatgtgacctaatatagaaaatgttattagtagtctcaatacagaactttagcaactttagcagcaagatcttgcaaaagcccaagcatgaagggttcccataaactggaaggagaataggaagctgcatgccagcaatccatgccaggcacacacagagagttacattcctccgggttctgtctgtggtcattttgcttcatccatgcgacatgtgtcagcgtcctacatctttctgaatggtttgggattcctacctgttaaatctcctgaaaagaacgtgaccatgcctggcactacttcgttccaatgaaaataaatgaatgcagagaactttcagtaaatgaattttacaggactgcataagtcatggaaaagtaaaaattgggcatcagctttcaaaagaataatgaatgaaagaactcatgaaacaacagtcttatatagtggaaagttatcactcccttcaatgatgttaaatagagctattaaaatccactctaatgtcttatatttaaaaatgcaattttcagatcctccttatgttagcaagttttaaaaatatataaagatgatgtttacaacagatgggcagaatgggtgtcactctctcacgaacagctcaatgctgtgctgctctcaattgccctgtggctattatttaaacatgcaaagagaatgagacagcccaatagtttggtttcaagttatttgatatagctgcccagtctcttcttctctaacttgcttgagaagtgatacgcaaagatagtcaacaatgacaaataggtgatattttaattgaacttcataaatgttattggccaatctccactttgccaaacattgttctctgtactgcatttctttacagagtccatttcaaagccaccaaatttgtatagttaaaacatctggagatacagagacggcgtaaaaataagttataagaaattgatacgttggacagcctttgccttgctatctcttttcccttcattaggtggcagaaattcaatgggttcatgacatcattatgatgttagtggaagaataattgatctattacctccaaaataaccagacacatcacagacagtatttctctggcttataagatccaagcaatgtgttttaccttaaattttccgagctgaattctgactctagaaatttaaggaactgttctctcccaactgggtctttcaatgcctcgtccatgccaaaaccccatcgttttaccctctgctggctcggttctttgctatagaagataaaacaaaggcaaatacattcctttcattagaattcccatttttttgttattacattccccttcaaaatcatgtgtgcctcgaagttcccatctttaccttttctttaaaaatatatatatccgattaacggctctgcatgaaatcatcgtgtacattagtattaataataaagtctaacatttattgagcattatgtgccaggcactttacataaatggtctctttttgtttttgccaaccactttatgagatagccactattaatcttattattttccagatgaggacagtgaggcacagtattatcacttgccaatgtcaggcaagtaataaggggtaaagatccagatattctgaccccagtgccacatttcttttttcttttttttttttttgagatggagttttgctcttgtcacccaggttggagtgcaatggcgtgatctcggctcactgcaacctccacctcccgggttcaagagagtctcctgcttcagcctcccgggtagctggtattacaggcacctgccactatgcccggctactttttgtatttttagtagagatggggtttcaccactttggtcaggctggtctcgaactcctgacctcaggtgatccacccaccaaagcgtcccaaagtgttgggattacaggtgtgcgccaccatgccaggcacacatttcttaaccactacgccacacagggtcatgcaggtatattgaactggggaaaatgcattggtaaccaaaagatctcaatactagctaatgattctggtgtcaattaaatctgtgacctaatcccaactgagtcacaacattttggggttccagctttctcatctataaaatctttagcttgtggaggaagagttctgggcatgtccagtgtttaagattcatggctggatgcaaaagtgagagagaccagaaatgcaatctagagaactgctagaagtgtgacagagcacccatcttttctttgtaaagtgatacgccatgatcctcttatgagtctgttaagactgatgatgtagttctttccctagatagctcatgaaagaaactatggagtcctaagtggtgctttgcttttcttaggaagtgtcttgccagtttctcttacagtgtctatggtaagctcattctgtcttaaaattgaatttataaagacatacttgtgttgggcttaagtatgtatggctttagcattcactttacttgactacatgagactttgtggctacgtgaattttccaggaagataatagcaatgagctaaatttcaagagctgaagatcctaactctgactaattgcacctctaattttgggacggtctttccagcaatgcaaatcttaatgcaaatgcaaatcttaatgcaaatgcaaatgtctaagtttcaaaagccatgatctcgaacaagaatgttagatataggccaatgtagataaagaacaaaattacattcacaattagccaacaataaaatccttcccatttcactcagaccctgaaataaagcaacatatgggcgagaaagataaaatgccacctaccttgcctcaagttcccagaaagtggtgtcatcggacagccatgggttagaagggtcaggtggcaaaagaaacgggtcgtattctaaatactgttccgtgtaacttagtagactaaggagaaaaaacatttccagtttctttagttttctgactggggttgcagccagtccaaagcagggaaaacaatataaaaatgtgggaccaaggaatccttgttcacttaaagcatgaaatccaatggcaatcttcacgcttcagtaactttcatgcaacaacttattgtgcttcttggcagacaactgtggctaaagattccatctctacccatgcctaagccatgtaaatcagtatcccttggttaacatgaagcactatggaagaggtcagtgtgtgaagggcaccgctaagagtcagttccaatctttggttaatcagtccacccacagcagaacagattttatacaactgagagaagggcttaaaagggaaattttgtcaaaagtatttacaggaattaagtaaaatgggagccactgacaagttttttaaatgtatataaaaattttaaaaagggagaagggaaagaagttggggaggtaggatttggcaatgcccaaaagtgaagaatatgaatggcattaagaacagatttaaatgaagcaaaggaaaatatctgaaatttgagtttcattcatattctgaagtcaggcaggaacagtgtcaattgtcattgttaaaataagtttatagagaggctccagtttgcccaaaggtcatcaataaatggaaagtttcatgtcttccagcaggagtgaaaaggctagactctgcagaattatcctctatatctgattcttagtggaacaaggactggatgtctagacatttaagacaattataatcattctgtcatttaaactacatcaaaagagttctttgaaagtttttctatgtgcaaaaaggaaaacaaaatcacattacttacaggattccaattatctgtcccaactcctgtccccacagttctctttcatttttaaacacatgtaattgtcatatgaaattttaaaatttatacagacactttgaaatactcacctgtcagcgacttttgacatttttaaccgatgtctatctaactgtatttgccaatattttatctgaaaagagggttagagaaggagttacataagtaatgacattttcacaattttccactctaaatcatgatcagctgggcaattctgaacaagagtatagtctacgtcagtacaatttcaaagttggttaaaaaaatagaagcagagggctcttaaagagttaacaaaatgaaatgttggaatttgaacacaattgatatcactttagaagagcaatgagtttgaccattctgcctactttaacaaaatgtgattttattttaaaattgtagagattttgctgggtgcagtggctcatgcctgtaatcctagcactttgggaggtcaaggtgggtggatcacttgagcccaggaattcgagaccagcctggccaacatagtgagaccctgtctgtaaaaaaatatatacaaaaagtagccaggtgtagtggtgcaggtactatagtcccagctactctgggggctgaggcaggaggatcacctgggactctgaagcagaggttgcagtgagctgagatcacaccactgcactccagcctgggtgacagaacaagattctgtctcaaaaaaataaaaaataaaattgtagagattttaaacgttcattcatggtgaatacctaaatccagaatcatacttccctccaaatttagaaaataaatgtatttattactataatttcaaaataaatcctatctcctaataccaagaaagtatcaatgatatgtgttttgagaataattttatcaacaattcatgacaaatgctcacatggaataatcacacacagaaaactttaattaaaaacgctctgaatgacttttccttcctgattattgtaaatatactagaaaagtatattttacactcttgataaactatattataataaaatatcagaggaaaagagtcaaaatgagaataaagccccataactgaaccaatcatgagattatttgatttcagacactggagtttgctttgaaatattacttggagtcaacaccattgatcaaatgctaaaaaaaagaggtagtgtatagcatgactccatggctgtacgccagtggtgataagaaaaaacttcaagaggtagagagaaatcagcactgcagaaagcgagagtaagcactcttgtgaagaaaatgtcctatcattggatgtgggaagtgtgacaatgttctcaacctcttgtcctcttactctttaaaagagagctttggagtacaaagtaactattgatgatggagtcacttacaaatcagcatatgtgatttttacaattggttagaggaacaaggatttgggtaaataaagagtgaggggttttgaaaaccattaccatatattgatacattttcaagtaattacaatacttaaaattacaacattttattatcttttaactgcaaatcttccacatgaaacagtcagtcatacaaataacctataaaaatacccactattaacatttaccctctggttttcatagctgttactctgtaaacctttaacaggtcatctcataggttgactcacctgttgttgtaactcatcttctgttggaggtttagtttctggtgtgggtgtgtgggtaggactgtgacttctaatatcattttgtaaaccatagacagactatattaaaataaaaaataaacattttaggacaaaataccgtttacagtcacagactttctaaaaagtaactctagcataaattcagtaaggtctctcaaagcttatttgattaagcttcttaacaaaattcaaaaggcactgctaagataaaaatcaaatgcatataaaatagaagcacagctcggaaaaaatgtgtagttagattattaactttgacagaataattggttatatgtagagagcaaggtgcatgtgataaaatttgagagcaagctgggaataccaagttggagaatgtcaacactaactaacatttcataagcattgatttaagaaaatagagaggtggatgaagaatagaataggaatgcaataactcaaaagaagatttaaaaataactcgatattttacataggaattaaatggggcactgaggagagtgacaagtcaagaattctattgctgatttgatttctgatggtgcaatagaagacaccagggtactcctactctccatatcaacagtgggttatttacttcacaacactagccttgccattgggtgccatttgcaaacatcagtgaccccagaggcgtcatgcatcttcggaattctcaatacccttgtattttttaattaacttgtcaaaaggtcagacctactacttaggaagactcttttttgagaaaggcccattgcttagtaagtataaataaagatctggtgactaaagggataaaaaactatctgtaactgactatgagacatctcacgtgtcaactcaaggaagaagccaaattatttcttcttggatatcaaagtattattcctttaaaataaagaatttaatgtgtgttattgagcactttttctttggatatgagcaagaaggatgagggcataataaaactgcatgagctccacaaaattagtaccagataaagtttacaaagacacttttgaaattagatgaggttagatccagatgcctaatgatgccaattttcaggcccgtcaccaagcttgccaatatctctaaattcaatgtgtttttattcctgaactgctttcacttggaccttaaatccacttaacactacgtcttgactctgtatctgtcttgactctgtatctgcaccttttggatgtggttttgcccttgtgtctcccgccctccgtcctttttatttttatttttttgagacagagtctcattctgtcattcaggctggagtgcagtggcgtaatcttggctcaccgcaacctccgtctcctgggttcaagtgactctcttgcctcagcctcccaagtagctgagattacaggcacgtgccaccacacccggctaatttttgtatttttagtagagatggggtttcaccatgttggccaggctggtcttgaactcctgacctcaggcgacccatccgccttggcctcccaaaatgctgggattacaggcgtgagccaccgcgcctggcctccgtcctttttttggtgctcttatcctttctttatagattttaacttggacttaatcattggaataatctattcccagactatcttgggtaggcctcttcagtgtcctttcttgccctaccaccagaaccttggaacccaattcccatcactgaggatatccatttcttttttttctttttttataatgccaaacaagaggcaggaaatggccatccatttcaacacaaggatttgctcatatgctttgaatttactctgaacaggacggagctgaatgtcttaaactagcccttttatttcatttattttttcactcattcattcattcattcaacatttattgaacacttactatatactagatatagtactaagcattagggaaatacaaataaacaaaatagatgtgcttctttctgcactgggactcacaatccagtggaagggaaagaagttacacaggtaattacacaaataaacatatgactaaaaaagggagcagtattatgaaacaaaaaagaataacaagcatagggcctggaatataaagtgatttaatttacactgaaggaatggaaatggcccaaactgatactagccatatttgaacatgattaaataaaacaaccttctgaattctgaaataacagtagaggttgatttcttaaaaattatgtgttatatacataatggaacactattcagcctttatagaacaagaaattctgtcatttgcaataacatggatgagcctagaggacattatgtttagtgaaatatgctaggcagagaggtctttaccatagaattacacttatatgtggaatataaaaaagctaaagtagagagtagagtgacagttaccagaggctgggatagggggtgaggaaaagaaagctcttggtcaacgggtacaaagttagttagttaggaggaataagctctggtgttctattggacagcaaggtgactattgttaataataatgtattccatatttcaaagtaactaaaagagaggattttaaatgttcttgccacaaaaaggataaatatttgaggtgacgaatatgttgattactctgatttgttcattccatggtatatatgtttattgaatattacccgataaatatgtgcaattattatttgtcaattaaaattaggcaacagaaagatcaccaattatataatagttctacctttcagtatctgctagtttttcaactgtatcaccttaatttttgagaagaaaaataaaaagactctgagacttgaagtttccattcttttttaacttggtttaattatttaaagtttttaaataataatctacaggtcatataaacagtgcttataaaaaatagctgatggttttaacagtaagtttttaggcgaagattaaaaaaataacataaaagactgctagaaaaacacagcaatttgtggtatcatgaaagtaaaatgatctataagttatcttttatctctacatttctataatgatttcaacatttatgcatttcctgtaaacttcatagaggtccgatacgaggccgggcgtggtggctcatgcctgtaatcccagtactttgggaggctgaggcaggcatatcatgagatcaggagatagaaaccactctggccaacatggtgaaaccccatctctactgaaaatacaaaattagccaggcatggcggcatgtgcctgtggtcccagctacttgggaggctgaggcaggagaatcacgtggacccaggaggcagaggctgcagtgagccaagatcgcaccattgcattccagtctggcaacagagtgagactccatctccacaaaaaaaacaaaacaaaaacacaaaggtcccataagagaccatgacccaaaccattgggaggtgttgcttaaaacatcttccaggagcctggctacttgctctgaagttactgcagagtttccatttcttgtcttacgtaaaagtcaacatcaggaagtctccctttcaccaatctgagtactgttcatttcctggggatagtgatagcgtttaactttgattgttggctacaatgaaaacagccgagaagaatataattttacatatggggattattttatggacaaaggaggcaaagagattaatcctattttggcagacaaattatgaaaattatttgcaatgtaaaaggctttgcatgttttagaaaaaaaatgtattcaaatcgtggtacagggtggggtggcatagaactagaaacaggtaaggttagagaggaagagaaataaaatctcttaatgtcttaatatttgcagctggggaaaatcaaattaactaattgagatccatttttagttttaatagcaagatcatttatttgcaatgctttggcttgattaacacgttcctttattcctatggtgctaagacaagcactttttcatatgcagtgccatctatttattcattaaataaaatagattcggcctcctacataaatctgttcatgtgtgatttcccttgacattttagaagagaactagaaaaattatcccgtttttttttttaggcagggggtgggggtttgctatggtctgaatgtttgtgtctctccaaaattcttatgttgaaatcctcaacccctaatgtgatggtattaaaaggtggggactttgggaggtgactaggtatgagggtgaagcccttgtgaatgggattagtgcccttataaagaggcctgagggagctcgtttgccgattccacgatgtgaggacacagcgagaaggcaccatctttgaagcacagagtgagctcgcgaaagatattaaatctgctggtgccttgatcttggacttctcagactccagaattgtgagcaatacatttctgttgtttataaattacccagtctaagatattttgtcacagcaactcaaacagaccaagaactaagtcagagacagtaaaatagaaaccacaaagtacaagaagcctttctgtgtttctatgtgaaatgtaatctctggggcttttctgactgactggtgtggtagtatttctctttctttcacggttgctcagctgagctagagaacagattgtgaccatatctgacacaatatggaggaagtcagtacacagaaagaagcagagagaaggcaaccagagagagaaatcatgagagagctgggtcgactcacacctctgggcaagcttgaccactgcctgccacaaggtttcagaccatgaatcagaaaagtcccctcttggccgggtgtggtggctcatgtctgtaatcccagcacttagggaggctgaagcaagtggatcacctgaggtcaggagttcgagaccagtctaggcaacatggtgaaaccccatctctactaaaaatacaaaatgagcagggtgtggtggcacatgcctgtagtcccagctacttgggaggctgagacaggagaatcacttgaacctgcgaggcagaggctgcagtgagccgagatcccgccactgcaccccagcctgggcaagacagagtgagactccatttcaaaaaaagaaaactcccctctttattcattttcatttgagcagtttctattgcctgcacctttactataccctttacttgacacacttttgtgttgttctaagacaagagtagtttattctgttcagtaacacattaaaatttaaatgtacacatgctgtatatggagttgaagacatgtccatattttatgcagaaacagctagaaccactggattattaatagcaggaaaaccagacagctaattatacatttgctgttgtttttctaggatgtgcacattagcttttcactgatgctgttaactgtaatatttagtgccatgatgtccaaatgaaggtgacagaggaaaaagagaacaggataggaaatagcttactgttattttgaaatatgggtgctaagttacaggagggagcccaaagtgtgggtccaatcacacatacatgcagatgctcttatcatttccctcaggttttgtgacctaggacccctctagctattgtcctacagaaggatacagcctgtggtggtgaattttgtgtcaacttggctggctcatagtactcagatatgtggacaaacattactgtggatgtttctttgatggtgtttattggatgggattaacatttaaatcaatggactttgagtaaagcagtttgcccttcacaatgcgggtgggcctcatccaatcagttgaagtccttaatagaacaaaggctgacctcccctgagcaagaagggattctgtctccagactgccttttttgttgttgtttgttgttttgaagaacaaggatatttactcttaaaaaagaagcgctgtcccacaaaaagatgtacagatttgaaaaacacttattttactgtattaaaaaacaacaacaacagaaaaacaggcaggggatgtctagatggcagaattgaagcagctctgtacgaaaatgaagatggtacgatgatgtgacttcaaagaaaatgactaaaacaaaatttcacaaacatcttcacgtttctaataataatgcacaaaatatcaaaaatacaaagtctgggtttcttccctgtaggtttatgataaactattaaacttctatttaatgcatttactttcataagccttctttgtttagaagtacaagctatacaagtacatacatgctggtattttaccatgaaaatttcacttttcatctcaaactagtgatttgtcttcttacccatacttatatacatttcacttccatcataagacatgtaatacatttctagtggtacattttaatcaatatatattttttaaatattgatttttaaaagaatctttttagtgctatgatacgatggccttaatttaacagctgaagcatgatatggtaactacactgtactgtttaattttcagctgtaggaaaacatttgagttttaaaatataaccaagatgaggctggatagtaataaacaccgaaatactagaaaacagtgaacgaataaataatacattttttttcatcaggggctattcatcattttgtttttagaaacctggaagaaattgtcttgagtttcaaatgttctggtaaatctagtcgtttcttagcctcctcaatgtcacctggaattgctgaaataagtgagtctaaagaatcaaagttcttttctggtctgaggtagccaacaatggccacattggggatttccccatagaagtcctctttgaaggtatgcaggataagcgtgtccatggacttcttcgtattcttgtggtagagggtccatcctatgctcaccaccacctaaaggccatctccacttccgacactggcccaaccataataaatgccaatggatacatcaactggaagattagctactacttgttctggaaaattagctgcggagatgcccagcggcctggagccacggccgaagccccgcaccacttgggcccggcagaggcagggcagatgcctcacgttatagtccagtccgctcaggacacgggctgcggccgggtccgcgcgttctacggagccgccatcgacgcggtgcccggaccctggatcagcaaggggtggggtggggacatggccgtgagctctgcctgccgcgggggcgcaccaggggcctggcgacaagacgacacgccgcggtgggtccctgaggcaaccaacccaacaaaagcttcccggcgactcaagagctgtgtctccccagactgcctttggatttgaactgccactcttccctaggtctccagcctggtggcctcccccatgagattttgaactcgccaagcctcagtaatcctgggagtcaatgccttaatataaatctctgtctctgtctctctcccccctcccgccccccactctgtctctggttcggtttctctggagaactctggctaatacagaatctattacagtaaaaattttagtatcggactcaagaacatcagaccgacagttccccttcaaacttacttagattaggctgatttctttctggctatgctacattatcattctttcacagatccttgagataatacatttttacctatttccttatattgtagtaaagtatattctaattaaaaagaaagacttgaaaatagactaattttagattcttaacatatctcaaatcatgcatacagcaaagccttcgcttcctatatttgataaacatgtcaaacattcaacaattagatacaacattcccaaatgaaatgtgaaatgattctgatattcttcaggcacctatgctagattgttactttagggatttactgggtcctttattcttgtcacggcacgtaattacaggaaaaattattatagctcactcccaaagaaatgaacagcagctctccttgctacgagcattatctgctttcaaagtttaagcatgttccatagcttccacttcctgagcagccacagtataaagatggaggccgaccacacagccaggaggaggcgctacagagacggctcaattatggcggaagggaagggtggcttccaggggcaactggctggcctctgccatttctgtctgtggtttgtgatctcacagcgtcacctgctccgcagatacagagctgtggacccctcagagggtggtgaaacagcttgctgattgctgtcaaggtattcactgacaaaatgcagtggcaatcacaagcacgaatcacgtacactccctttgtcatatgtcatggacggagttgtgtcccctcccctaaattcttatgttgcagccctatcccccaacatagctatatttggagatcaggcctgtgaagaggaaataaaggttaggtgggttatagggtgggaactaatacaatagaactggtgtccttttaagaagaggaagagaccccagagttggttgttttgttttgtttttctctctgtctctatgcacacacaggaaaagccactgaggacacgagaagaaggcagccatccccaagcaggaagagacactccacaggaactgaacttgccaccaccctgatctcgaacttctagtttccgtaactatgaggtaacaaattcctactgtttaaaccacctagtttgtggcattttgttaaggcggccccggcagactacatgaagcttaacaaaatcatatacttatatccatgtacagacatttatctccttgctcaacacctgcacccttatgagaccatgaattaggggagcaaggccctgactgtcccatttactgtggagtacctaaagcccaggacatgtctggcatagagtacagactccttaattttgctaattcagtggatcattacagttcctaaacaactatgagctaaagtatcagtggtgatacttctaaaaaatattagtatgtggcttggagtcggataaccttccatgtaaaataacattatcatctgcgaagattctagcaaattgaacacttctgactgtgagaagctacatttatcaaaaggtgagaaaaatccgttttctccaactgtggaaaataagggtatacctgttatttgctgtcagatttttcaggacttttgttttcttctggcaaatgttagcgctagacagctctggagtgaggccctgtcattctgttgttactgattcacaagaaattagatgttatcgagacaaagagagctagatctcaatgactctgtttctttacaatatttcaccttgcaatgcctcatgggcttttcatcattaaatgagggctgatggtatgtaaagaacgacattgtaaactaatgcttctcaagtgttcaaaaagaagggtgccatgtgaaacacgagaaagatgatctatactgaatatggtgccgaagagagagtataaatgatgactttattgtgtctaggtgctatcttgttaatccatatgcattctcttctgaatcacagcatgtctgtgttagggtctgttgggggaaacaggacacccaataaagtatttcgaagagtaatttcactattcagaaagtggagagaggtggcttaatgcactttttggagagccgatagcatttttgaatcttgttctgcaaaaatagttcttggtgccctcaggatgtgctgtgagcagaggatgaaagcaattaagttgggccagccaccagagagacagaccagacaggcttgctttggtctggcttcgcctctctcttggagagttcctacgggcagaagcatttgagcaccgcatccgaattggttttgtggtgctttgcttcagcttctttatcctaacatcaaggtaaactgccttaaaagaaagaaaaggtacttggaccatattggggcctttgaacatgatggtatgtttctagggatgggagaaaatggcaacacaaaataagactagaaaaaaatattgagtgcttactacagggacacagactctggaaaacacgatggctaacgaaatactaaggaaatggccacagaaaaaagaccttgaactttgtggaatgtattaatccagcagcaccaatctataagctgtgttctcaaagcgactgctacaggccagaaattcttgtgtacatcaagcgtgttttatagaatgaataaaaatgccttctagttgtacgtgttgctttaaaaaatatgtagaaactattgctgtgcattttcaaagggttatttaaaatgtcactggactcagaatagcttcccccacaccctgcacaccgatattctctcagataacaaacactgaaatacaaccactgtcttatggttgtatcacaaaattctagtgttaagaggggcccctgcactctttctggaattaaatatcttttagatgtccccctttcctcaggttttaaaatgcccttctctcatcagtatcaggttttctaaagatgatttccttagaaatcctgttcctctcgtctcagtcagtcatgaccaccgctctgtcttgggaccctggtgtgcttgagcattagggtggggctattcttgaggaagggagggctgtggaaggctgggaagagtgggaaagatactgcatgacatgagaagaaagtgtttttatggctgacgtcctgtaaacaatgcaatccatcaccaagatcagcacaacaaatgacagttttaccttccgtgttttgtgggggtttctcattctggatgacttcttaatgtccacttcagttgtatttacacatccaggctgggaatggaaaaacagagagacaaatgaatctttgggtgtgaaatttctgaccaggacaatcatgaatggctcgctctccagagcccgagcaaatgccccaatgacacaaatcaagggaggtgttttctagatggccacagccagtcccatcagcagtagccagtcataaaagacatgatacttcttaactcttcacacttaaaagccttcagatgctatcctcaaataactcccagagaaacaggaaaaagaaatactcggactgcacatgtgaaagtggtgtcaatacgtatagcgacaaacccgacagacagagtgagggcactcctggacaaagagataccccttgctggttttctgcagacagcctctcgcagagatctctctttataaaaagtgaggctgggccgggcgcagtgactcatgcctgtaatcccagcactttgggaagctgaggtgggtggatcacctgaggtaaggagttcgagaccagcctgaccaatatggtgaaaccctgtctctactaaaaatacaaaaaattagctgggcgtggtggcgggtgcctgtaatcccagatacttaggaggctgaggcaggagaatcacttgaacccgggaggtggaggttgcagtgagtcaagatcacaccattgcactccagcctgggcaacaagagcaaaactccattgcaaaaaaaaaaaaaaaaaaaaaaaacaggctgttattagatgggtgccttgcttttcccaggctggaagactaaaatggcatttagttgagccagctcacatcccagaatgaactgtcttacaaggattgtgaaacccagcaactaggaatccttgtttgccatagacagaatgtgcaatggagttcatggttaaaatgtgaaagatggagaaagaaactggtaaataagatgccatgcttcttctgataaattcctgaccttccttttccttaagggcaggtgaacccctttaaaacagaggggttgatgaagtataggcagcctgctgttagcttcctgacaacctcaggtgtctcatttgtcagatttattgttctgttgtacagaaacaaatagatgcaagctccttgtatatttggaggaggagaggggaggagggaggaagaagaggggaagggagagaacatgaatcacgaaacagagaagacaggagattcaaaaatacatagtagcttaaatgtagaaagggcttagacatcacacatcctttagaagtgatgagaagttaatggctacatggactgtgtttcctttacttttggtgcaggatttaacgatctctggtattagtaaaaaacatcggccaggtgcggtggctcacgcctgtaaccccagcactttgggaagccaaggtggatggatcatgaggtcaggagttcaagaccagcctggccaacatggtgaaaccccatctctactgaaaatacaaaaattagcaggacatggtggcaggcgcctgtagtcccagcttctctggaggctgaggcaggataatggcttgagcccaggaggtggaggttgcagtgagccaagattgcgccaatgcacgctagcctgggcaacaagagagaaactccatctcaaaacagacaaacaaacaaacaaaccatcaagttgcatgtctctgctcaatttctctatttcttcccacagactgcaagaaattaaagcattagatgtccttagaagtgactccagagaaactgtgaatacggaaaagtcttccgtggagttggggtggggttgggaagaaagggcaaaaaggcagagctgatgtgattggcagactcagctgttcactacagtaacgggaatcagttcattgtgtaatgaggacagaggacactttccttaaagaaccatctcctgctagtatagccattgggccaaaactccgccataatattataatagataaggaagtaaatgaggaaaacatttttttttgtagaatatgtatatactacagatacacacacacacactgtactacaaacattaaataaattatgagtttggtttgcatatctatttaggaatagaaatcactggttcagcacagtggtcagcttggcagtgtaggagggaggaagggcacccagctgggtgggactaatttcctaagtgacactgagcaattcactaaactctcccagcatctggttgctgagtatgtgatattgtggtttgatttttttttatggttggtctaagcatttgttttttaaaaagacccccggggattttaatctgcagccggagttcacaaccactgatgtaggtgtaacaaagacaaggtttttaaaacattaaaggatcgagttttcactttccattcgatttctatttctttgcagccttccatccctaagcctgagccataacggaagggaaggcagtaaaattctttaaactcctatcaacatatcaggagccaagcacagtgccaggtgcagtggcttatgcctgtaatctcagcatttggagaggctgaggtgggaggatcacttgctttgaggagtttgaggctgcagtgagctgtgactgagccaccacactccagcctgggtgatagggtgagattctgtctctctctgtctttctttttcttttttttaaagagccaagtatgataagatgtgtcatagagattttcttccatatgttaaggggtgggaaaaattaggatataatatccaggaaaaggaaagcatgtttcttcatgacctggaggcaaagaaagataaaggtaagatactgagctcagcaggtgtttcatttttctcctctgtggaagaaactcgaagaagaagaggtgatagggaggaataaaaagtcccagacaagtatgaggaagcctgtgaagtagtcagtcccattcccatagaagaagccccacatgcaatccgagccaacatgaattttatatcatatgggtgttagcaagaaagatgagcttaagaaaatgcttcccaagcctcttatgtggcagtcaagccatccggagtttcttgcatgccacagtagtaaaaggcacagaagatctaagaatagtgggtggatgggagcctgaagttgggacaaaggctgcagtgtgcagggattttatgctggaagcagatgtctgaaacacaaacttcagcagtgagttccaggtgatgagatggtacctgttgcaacatgcaaacctgtctatagcagaaatcgacaaggatctggaagatgttctgggggtgcttggccctctggccccactgcacaagactgtaaaaacaaaacctctagaccccaaactctcttccaaaccaatcctggatagcagcagagaaaggccgagaaaactgaaaatgtaatcatttatccacaaatgaccgagtcatctaaaccaactatttcaattatggtggcatgcagagcacatgcgttgaaacctacccttcaaataggtttctgagaaaactatgtcaattatagaaaataaagaaactgtattttctttatacatctgaggaagctgaactaatttgaactctaaactccttccataaagagctaggattccaaatcaattttacttcataccaggggtcataattaacaaatggccctggaaatcgtgtcaaccattgaaggcataaagtggaaagattcccctccccagaggaacatatctgactgtcagtcctgaaggaaattagaagtttcatcctcatatttaaaagatgatggccttttaaatttgattaatgaaccattagcttacatctgaaattcccacttgagccaattattaacaccactaatcagcaaattaataagaaagcattgattttaaaagtaaatgtcattagagactgaacggtaagatatgttttataacccggctcccatcccaggaaaatgaaatctgccagttcaaagtttgttactaatgactaaatggttaaaatagtaagctggatctgggatgcttgtctcggaggccctgtaatttctaatgaggcctcatgggacagctaatggttcaacagatctatgatatctaagtcaactaggaaattcttgaagattaaaaaagcttagaggcccaaagttgcctggaatacttctgaataattaaggtcatgacccagtgctgataacccctgaataactgctttcagaagtcatgcactgtggtaagtgaaatatggcaataatttttcttgaattctcttatgtattcaataaatatttctttctgcatctaattgtcggatcttgtgacaaatggtgagttacagaaatgaaggcacgagccctatcccagtaacttcctgatacaataaaaacgacagacacatgaataatcagaatatgggagcataatgactaagtggaagttggcacagagcattacatgacaacagaacattccagacatcctttttttttttttttttttcctgagacggagtttcactcttgttgcccaggctggagtgcaatggcgcaatctcggctcactgcaaccgctgcctcctgggttcaagtgattctcctgtctcagccttctgagtagctgggattacaggcgggtgccaccacacccagctaattttttgtatttttagtagagacaaggttttgccatgttggccaggctggtctcgaactcctgacctcaggtgatccacccgccttggcctcccgaagtgctggaattacaggcatgagtcactgtgcatggccaagacagacatccatttttatgcacagtctgttggttctcctcaacatggcaaacactattcctttaaaagttatttttaagcaatttttcaatctcgatgagaccatgttgtctttggttatttaaaaaaaagtcaatcatctttttgatgcatatataataggtaccactagctggcaccagaccttcgtgaaattcgtaaaattggtttctgcagagctaaacaaatctatcttcccaataagatataaataacattaccattaccaagtagacattccattaaaatcttcaaatatatactatttgctggatacagtattaagcacatagtattgttggatgtaaggaataatgaaatgctatttacatcagcctggaagagaattgtgttatttctagtgattcaaagatgaatttcttttcaaccgaactaagctgggttgcaacattattataacgttatttattataaagtaggatttaacattgtggaagccactcctgagggagtaaacggagcatatcattgagaaatactactgtcataacatttacgtgagtgtcctcatgaggtgcaaaagagaagctggagtttttggtttcattattgatattttaagtaaaagcatctaaatgccatttagttcctttcatgcgatagtacatttttgttagttatagcagaaggtacacttgtgttcaagacaactcggcaaagcctgtggtgaagagcgacagtgagagagaggaatacagaacagctgtgtttaagttccatcactgcagctgatgtgtacctgggagaacagtgtcctaaacgacaggtgagtggaggattagaaatgcaccatcaaatagagctgatagcaagacatcaagtacaccctagaaagttttaaaaaatcatgattctgggaaaattcaggtttcaaatatgcatagtccccccttatcctggggggatatgttttactactgcccacccccacaaaagagatgcctgaaaccacggatagtaccaaaccctatatatgctgtttttcttatatatacacatgcttatcataaagtttaacttataaattaggaacaataagaaattaacaacaataactaataataaaatagaaaacaacaataagtaataataaaataataaaatatgccagcctcactgcgcttgggctttggggtcattctgaagtaaagtaagggtgactcgaacacaagcactgcaataccaggacagtcgatctgataacctagaagactactaagtgcctaacaggtgggtaccacagacagcgtggatctgctggacaaaggggtgactcatgttccaggtggggcagaatgggatagacgagatttcatcatgctactcagaatggcacgaaattacaaacttatgcattgtttcttgaattttccatttaatatttttggactgcagttgactgtgggtaactgaaaccacagagtgcaaccatagataagggggagctactgtatttagatggtccctgacttactatggctcaacttaaaatttttcacccttactgtgagtttattagagtattaaatgcatttttgacttactatatttttggcttacagtggctttattgggacataaccccattgtaggtcaaggagcatctgtatatatattaattcaaatagaagtaaattaatgaaaaagagtcaccgctttgtaatacagtacaagttataaaaactgcatgcatgatccatagtaccccagtaagaatgatcccttattcttacatgaagtaattatagattttaaagtgttcacttacatgaagtaactatagattttaaagtgttcagtctcaggacttttttttttttggcccaggctggaatgcagtggtgcaatcacagctcactatagccttgacttcctgggctcaagcaatcctcttgtctcagcctcttgagtagctggtactacaggtgagtgccaccatgtctggctaatattttatttttaatttttagtagagacagggtcttgctccgttgcccaggctggtctccaactcctggcctcaagcagtcctcccatctcagcctcctaaagctctggtattacaggtgcgaagcactgtgcctagccaggattctttttttaaagatccaattcaagcttttcttcattttcttaggcagttgtcagttgattcagcctctgatcctttcagccctcctcctcccgacccatctacttactaagtcctacgcacaaactgaagaaagttgtttgaggaaattgctccaaatttcttccattcactcttctctatagtatttactcatttgattcctattaggcctcatttgctagctacagactcttgggtatgatatcttgcttcagtgtatgctgtgaatgaactccacacatccaagaggcagaaggaaacagaatcatacgaagtcagcctgaagctgtggaaagtgggcaggttgagtagaagtcacagaccatgataaggtggtaaggactttggtttaattctttatttttatttttaaggttttttttgtttgtttgttttgagatggagtctcgctccaccgcccagactggagtgcaggggcgtgacctcggctcactgcaagctccgcctcccgggttcacgccattctcctgcctcagcctcccgagtagctgggactacaggtgtccgccaccacgcccagctaatttttttgtatttttagtagagacggggtttcaccgtgttagccaggatggtctccatctcctgacctcgtgatccgcccgcctcggcctcccaaaatgctgagattacaggcttgagccaccgcgcccagcccgactttggcttaattctaaacataattggaagccactggagagttttaaacaggagagtgacttcatatgatttatttttcaaaactcattcagaccttacactccacacacacacacacacacacacacacacacacacacacaaactcaaaatgaatcataaacctaaatgtaaaatgctaaattataaaatttttagaaaataacaggagaacatctaggtgaccttgagttgggtgatgactttttagataccctatcgaaggcacaatccatgaaagaaataattggtaacttggatttcattaaaattaaaaacttctgttctgtgaaagatactgtcaagagaatgagaagacaggccacaaactggaaaaaaaataggcaaggttattatccaaaataagtaaagaactcttaaaacccaacaataagaagataccacaacccaattaacatatggacagatgatctgaacaggcacctcaccaaagaaaatatacagatggcaaatacatttatacaaagatgctccacatcgtatgtcattgggaaaacgcaaattgaaataacgagataccactacacacctattagaattgccaaaatccagaacgctgaaaacaccaattgctggcaagaatgtggagccacagagattctcattcattgccagtgggaatgcaaaatggttcagccactttgcaagacggtttggcagtttcttacaaaacactctaaccattcgatccagcaatcatcctcattggcatttacccaaattgagtcgaaaacttatgttcacaaaaaaacctgtacacggatgtttctagcagcttgttcttcataattgccgaaacttcaaagcaaccaagatgtcctttagtaggtgaatgtataaactgtggtacacccagacaatggaatattattcagcattaaaaagaaatgagccattaagccacaaaaagacaaggaggaaccttacgtgcgtattactaagtgaaagaagccaatctgaaaaagccacagattgtacgattccaatcatatgacattctggaaaaggcgaaacgatggagacaaatagttttgccttttccagatcagtggttgccaagggttgggaataaataggcccagcacggagaaattttagggtagtgaaactgtatgacactacaatagtgaatacatgtcattatacatttgtcaaaaccatagaatgtacaacatcaacagtgaactctaatgtaaactacagagtgcaggtgataatgatatatcagtgtcggttaatcgattacaacaaatgtaccgctctggtggggttgggggtggggggttgataatgggggcggctgtgggccggggagaggttgctggggaattcagtactttccacttaattttgctgtgaaccaaaactgctctaaaaaataaaattgattaaaaagcaaccaaacaaacaactcattcaagaatattgagcactttgagagtggattatcagggtgggaacagggcaaagcagaagcaaggggcccagtttgaaggttactgcaattattcaggcaagagattatggtgacgtgggtttgcctgccagcactagagatgatgtgaagtggttgcatctgggatgcattttgaagctataatcaacaaaacttgctgatgggttttgtctgtgggcatgctgaaggaaacagaatatcaaggatgactcccatgccatctgctgagatgggaaagcctgtgaaaagaagagaggaatccaaaatgatccctgggttgtatttacatacaatgtttgtatttgctgaagtctccaaagggaatgcaactctttatgcagtctctatgaagatcacgaatcagagcatttccaacacaaatgcctgtataatcatttgcccttggcctgtccttttgtgccattgcgtttttgcattatcactggtggtatgaacatatcattgaatctgcaacattaaaacatgatgatcaattcctgagaatttggtggagctgtctctcattactcagagtctctgctacactttcctaaattttctgtagtcctaccacattctattaatctgctctaattgaaatcagaccacttcagcctcacatctagcaactatctgtgcatccttcaatgacattccctttttatagactaggaattgccttgcaggtaccattctcaaagagcaaccaagaggactctaaccagtacatttgctatagcttctttgtggtcactgggattacccatgtttaatgttcagctttaaattacctaaaatgttcccagttagaactgctttgaaatttaaaaaatcactgggcagaagctaagttgtcataattatctttaaaataggggctcctgcaggaagaaacaaaaggcctgaggcaagtaagcgtggacactttcctgtgacacctggcctgctgtgcgcacatgagcgattgatgtccttccctttctatgattatttccctacaaaaagctggctgcagtgtgaggacatgcaaagagtttcaattggatgagaaaaaaagtctctcttagatttgagactgaacatgtgtgctccaacttgttctatatcctgggttggcatattgggtacttttatacccataattgaactggcattttgatttgcattatactgttcctctggtatttcactggtgggagggtgagtagcaacacagaattttaggattcctggtctgtgggcttaaatgggtcatcaaacaccttaaacatttttactttaacacttaacatgtttcttgaatgcagaaattaagacatgaaatctaggctatgtctctggtgacaacataaatttccccaatgtaaaggtaaggtgccaaaaagtaggaaaatgaactagctactgaactggagaaaacaatctttatttttttacacagtgctattgttagtactggtgacttacatggtatgctgtaaaggctaaagagaaccaaataaaatttcatatagcatcaataactcacagtaaattcaagggcttataataatttttacaacagatagcaatgggacaactaggaaataagtttgtgaaaatcatcacatattggaattaaccttgaattacaatagctgccttgaattcaatagctttgaatcacaaaggatatggggggctcctaaatcataagttcccaaatagaaaaggggtgcatctccctgtcttagtctcttcagacttctataacaaaataccataaaccaggtggcttataaacaatagacatttatttctcacggttctggaggctgggaagttcaagatcaaggcagtgaaagattttgtgttgggtgagggtcacttttcagttcatagaaggttccttcttgctgtttcctcacatggtggaaggcataatagttctctcttggcctcttctgtaagggcactaatcccattcaagaggaaagaaccttcatgacctaatcaccttccaaagatcttagctcctaataccaccaccttggaggttaggaattcaacacatgaatttggggaggacacaaatgttcagaccagagccctccctttacaggacacacatacagagaaaggccataacacatacctcggtttagcaaaatctctgtaaagaagattaatttcaaagatatactctgttgcattcaacttgatttccaaaaagagaaaaagatgtagtggtgttagaaaagagatttttacataaagttcttttctagatttcatatttattgctaagagccaaaattttattttcagtgctagggaaaaaaaatcttttaaaataattcccatgcatcctcgcattcttacttaatcatatccaaaacaacagagtctttcttgatgatttgaggtcgtgattatttgaggacaatgcttattttttattattttttttttttttgagacagagtcttgctctgtcgcccaggctggagtgcagtggcgccatctcggctcaccgcaagctccgcctcctaggttcacgccattctcctgcctcagcctcctaattagctttaggattacaggattaggattacaggctaattttttttgtatttttagtagagacggggtttcaccatgttggccaagatggtctccatctcctgacctcgtgatccgcctgccttggcctcccaaagtgctgggatgacaggcgtaagccactgtgcccggcctattttgctgtctttaagacagcaatgcctatgaggctagatgatcccaactcctaatgccttttgagcttttatgtgattttatgccatttttagttcctctgccttatcccagttagctgtcactttttgctgctctcagcatccttgactccagcgcatctcattattctctaattcgttgcttggttctgatgtggatcagaaaactatacaaatgctcctttgccacagggtctcacattttagcgaatgaaccgatcaaagcacacggttagagtgtgagagtttaaacagctacttcggttaagactttttgagtttatttcttggctgagttttggatagaattagacttgaagatatgagaggtaagaaaaagtctcaaaactgtaacaaataaaatgtggacaagttctcatgatatatttaggaaaacttatcagtacatacatatcatagaagccaattaaagggggtcagaagtagatgacatcaaacatttatctggagttctaagaaagaggatggcatactgagagctagaaatttgttctgtgctccgaggggtggggagaaaagttaactgaggtgaagggcagcattcttgggttgcatctccccagatcctgagtgaacaatgatgcactctcttgtctacacccagattcttttggaaaaagcctgccagattcattgctaattttggtttagtttcccaaaaaggataaagtgtccaagccagaactctcagtttctctcccctcctacctattcttttcttggttttctgcctttcagtgagtgcctccaaccatccatcaagagactcaagccatcaccaaggaggcatcactaagccctcttttccccttacttcccacacttgattcatcagcgcatcatgcaaactttacctccaaatacaccccgaacctactggcttccctccaccctcactgttaccaccctgctccaagctgccatgatctcccatctggactatcacaacagccttcttatttgttctaattcctctcttgctttgtcctccctttccccaagttattctccacacagtagccagagtcacctttttaaactacagcgacatcacatcggtctcctcgtcaaacctccaaagggctctcgtcatgctcaggataaaaggcaaacaccttgccatgctctacgaggtgttacacttttcttttcttttttttttttgagatggagtctcgctccattgcccagggtggagtgcaatagcatgaactcagctcactgcaacttccgcctcctgggttcaagcgattctcctgcctcagcctcccgagtagctgggactacaggcatgcgccaccatgccagctaatttttgtagttttagtagagagacagggtttcaccatgttggccaggctggtcttgaactcctgacctcatcatccacccaccttggctgcacaaagtgctgggatttcaggcgtgacccactgcgcccggcctcactggccttctttgtgtaccaggcccttttctctgtactagatgctacttctttctccaaatactatgtagtccctctcgatcacatcaccttgcttttatttttatcatatcacttacctccacctggagggtttttgcacattacacttgtttgttttctctgtctttcaccactgaggggtaaattcctcaaatacagggacttcctatgtcttgtttagtatctgtcactggagtctgaaatttcctggtacctagtaggtgctcaatgaatgtttattgaatgaatgaatgtgaaagactttttgaacatacccatctattaaaaatacaaaatgagttttattttctgtttgcttgtgtgtatgtgtgtgtgtgtgcatttgtgtgtgcttgagaatgttggtacctataacttaacctcttggccgactgatcatcacctctcattattatcatacatttatttaacaggaaacaaatactccaattcttcagttagccttaaaagaaacatttctagtgcagaaaaatttagctcaaatgttcttttcctgtgcaatgtgattagcccatcagttgataagtgtaaatagcagattgcttccagatttgatgggggttaagtagttaaaaagcaggaagacactgggaacttacaaagcctcagttttagagaagtcaagatgagaatagagcaggcctctctgtccctgcctttataactttgtttaaagcggttcccatcttgacctacaaatatccaaggacaaacaaaatctgtgcccctatgcatttctttacccgggtgtgcaatggcacagcggagttcagacaacacaactgagccatattatacaaccagcacatctccactgggctgtattatggagctgaagattaaaaccccatatgagaaaaacctggattcaagatataaactaagaaaagataaagctaataacgcctcttctattgtgcagtactttgacatttttcaactataaccatcatctaatatgagtttcataagcattctctaaactatatagattagtcactatgaacctaattttcactgaagcatatcaaagattcaaaccttggaagagaatataaatattatctggtctaacttagcatccaattcatgatttcttctggcaacttctacgacaagagtcattcaaccttagctcgaatgcttgttgcctcctttcccctaaaatacctccatctgcatcacacttgaaagaaaatttttgaataagtcatttatttaaaggaccatgccacttttaaaacatgttaataatcatacctaaaaaagacaaataacatgatgacaaactagttaagattcttggaaaagtagaaacttctttaagccttggtgtctcttctttcagagcgagtgcaataaaaattgttccaacctcctcagtgtatgaaatactgcacgtaaaaggggtcagcacagttcttgacacacagaatatgcaaagcacatattagtttcccttagtattagtattattagcagtataatttgacatcaataaaataatcccatagaagcaagggactggttcttctatgatttcagattatgtttgtcaggaatttttttttttttttttgagacagagtctcactctgtcacccaggctggagtgcagtggcaagatcttggctcactgcaacccccgcctcccggtttcaagcgattctcatgcctcagcctcccgagtagctgggattacaggcatgcatcaccatgcccagctaatttttatatttttagtagagaccaccatgttggtcaggttggtctcaaactcctgacctcaggtgatccacctgccttggcctcccaaagtgctgggattacaggtgtgagccactgcgcctggctgtttgtcagtatttgaggaagttgcttatgaaagtaaacaagttgaactatactgaatggaggaaaagcaaaaagctaataaattttagtaattttaggccaaatatcagatttaatttttaaaaaggtaagcattttggggggggaataaatatagggtaagtgtggaggcaagagtgtaaaactcagttcacttcaaagttcttctgatatatcaagccagaccaatacgttggagttgcatttcctttctttctttcttccttccttccttccttcctttttctttctttctttcttttttggagttccattttcttaatggcagttttctttttttcttttttctttttctcataaggggtaactgctaacatttgaaaatatgtggccaagcgtggtggctcatgcctgtgatctcagcactttgggaggcctaggcgggtggatcacctgaggtcaggagttctagaccagcctggccaatatggtgaaaccccatctctactaaaaaaatacaaaaattagctaggcatggtggcgggtgcctttaatcccagctacttgggaggctgaggcaggagaattgcttgaacccaggaggcagaggttgcagtgagctgagatcatgccgctgcactccagcctcgggcacaagagcgaaactctatctcaaaaaaataaaataaaaataaaaataaaaaaagaaagagaaagaaagaaaaagaaagaagaaagaaagaatgaacatatgtaaggacaaatatctttttttcttttttctttttttttgggacagggtcttgctctgttgcccaggctgcaatgcagtggtgtgatctcagctcactgtaacttcaatttcctaggctcaggtgattctcctgcctcagcctcctaagtagctgagactacaggtgtgtatcaccatggctggctgatttttgtattttttgtagggatgaggttttgctatgttgcccaggctggtcttcaactcctgacctcaagtgatcctcctgccttggcctcccaaggtgtcaggattacaggcatgagccactatgcccggcctgacacatatctttatgttgagttttctcttaatgaaatgtaatttgttttgaaaaaatccagttattgattgtgaggaggtatatgcaattattgtgagggaaatagcagagctgaggagaaatctagagttttttgtatttgagagaggatttgctatcttttaaattaatccagattgcttttaattttaatttaattgtctttctcaggaaagagaaaattcatttgaagaagatagctgatgtcctattaagggaagacagcctatcttttctttctttcttttttaaaaatacaatttgtgcatctggggaaaagcaaatgaacagggaaaaaaaacaagctcaaataatgactgctctctgtgaaatcagagtccatgctggtcccgtcagggttctggcagactgagcccatgttgttagctcagccagcccctcaaagcctgtgtgcacgtgcatgcctgagtgtgtttgtacacattttaaatcttagtttcgctttgatatgatttcaaacctacaaggattgcaagagtggtttaaagaactcccatagactctttacccaggttctcctattgttaacatttggccccattttctccccttccttgtctatatttaaactactggcaaacagaaattcagctatagtaggaatggcccaagaggctggcttctcaatagagtatcagggttagatgctccccttccctccccgacacctgcccagacacccacaactatgcaagataccatcagtacttgagatcaatactatcctctatccacttccctgagagttagctgttggctcttaagaccttcctgctatcatcaccccaacccctatccacatcctcatcatttcagaagaaacaggacagaaatctgggctcatgattttgaaaagtcgccaatccacaagggataaaagcaccaacttaataataggggaagcagtttttattctcattctacccatggctcacataaatagcatcagatattacataataataggacactgtatctacaaatctattcagggatagaaagagcagacagaagatgaaagatatagccaggaagcaaaaaagaacagtttcactcatagcggcttgtgatagccagattgtcaaaatatttttcaatccaaaggaacagatgggaataatagacagaaatgctgttccattttcagagcacaaaagaaatatttaaatttggatgaacacattttggattttctaaaacagctcaaggtatcagtaatgagatcatggactattgataggaaagacagcatcatgagtatgggctgatttgaacttaagaacaaaaagcttgcacagttcctattgatttcaacctaatttgtttctcatgaacaccacaaaactgacaatgccaaagattaaaataggtatgtaactgatatcttccaagggaaatattagggaaaatattagggttctcctacagcttaagctccagatgagcacatgaaattatgcatgtggattgcacatcagttacaaaattaaaaagcaacctccctgaaatctatagaatactatacctgctggctcaaacccagaggtagacatgaacatttctaagggatatttatacctgttgcatttacttgacacaatccatgctgtgactcctttccagcagcctagcatggctgataatatgtagccgcctctcagagatgttgggacaatggacatatactgccctttgcctcagagttcaagtagacatgcaaggtgcaatagaccatttaatacataaaaaactcaattaatcatttcactaataagaaataaaaactagttaacatgcacaaagccggtcctggtgcgatataatatcctgctgtgtcttatgaattgacaaagtttgcatcctatgcaatagagatcacatggggttttggagaaaatgctaggttttcagtcatcattagggatttgactcttaaccatatcaaaaccaacaaaacccaactcttcagagtcttgctttctcttatttgttaattaaggaaaatagttacccaccccacgaagtcattgtaaagaataagtggtatgataaatctaaaaggcttttgccaccagaaactgctacacaggcaatcaatgttattgtcatcgatagtaatccacatgcattattgttctcttacattttgtagaaagaaatccaggtggcatgcatttaacatgtgttttagagtaatgtatcctgaagagagaagtagctcgaacagtaaaagggacaatgctggaaattgacaagcttctcgataactgacaaagtcctgttgcctcatctctggccactgctgccttggttggttcaaatattggagccccgtggaaaagaaaaatctgtgtgcttttgaaactaagtcagtatgtatttaatgtcatccaaaaggatgtagataggatgagggaaatcaagaattattaatttattcatgaattcaaaatctatccattgagtgtctgctgtgttcctggtacttgactgaggcctaaatacagagtcagggacaagtgaagcctagtctctgtcttcttatggggaacagttactacctcatatttaccatgtcattcccagtataaaaatcattcataaaaagtactttcatgttcatctcaaaagtttttttccttaatattatgaaagagatgatttgctctgcttaaatattgtggaagttaacctaaaatataagtgagtggtgagagacattctttagtttaggagggagatttggcaaagaactcatgcgccacagctgtgaggagtatacaggattatccccttattcccctcttgatctagggctttgttctcttcctcctgcttacaggttactgtaaggtggttccagcagcatctgcataggtcaccctcttcactgggaagggtttcattcatgctagggcttaacctagttttattttttccaccaccctttccaaattctattttcccagattctactgtggtgagtaccctccataacagtccctattgacctccttctgctggtattctcactctgtgtggtcccctcccacactgcaccagggttggtttgtgtaaccaataaactatgacagaagagatgacataccacttatgagattaggatatacaaacatgaggttttgacatggggctatctttctattttgggatgacatggcggaaactgtcttggacatccttatggagaggtgcatgtggccaggaactgaagctgcctgcaaaccaccatgtgaatgaagtgaaccatcagccccttcagatgaccatagccttggccaacagcttgactgatgcctcatgaaagaacctgagcctgcatcaccaggaaaaccactcctggattcctgactctcagtagctgtgtaaaatagtgaatatttgttgttttattccgctaaattttgggataatttgttatacggcaatagataactaatatacttaaccttcaaacttcaactccaactcttctgatccccaaaagtatttttcctgattataccagttcatagctatctgctaacctttttacccacctcctcatctccttttaaaagcatgattgctaaaataacttcagctaccaattactgaacaagggttgtgtgccaggtactgtcctaagcaatgtacaaatattatttccatgtgttctcaagggtcgtgtagggtaagtatttatttttcccatttcaaatgagaagtttgagacttggaggcatttagtaaaatctcactcaagaaggaagttggtgtttgagccaaatctttttagctgcagttgcatcccttgaacactacatcacataaaactgtcatagctgtgtgagttatcttgaagtctttgtatctgaggcagggaaaatataaatggagagagcctaagcacagtggcaggagtgggaagagaagtgagaatttttatgtaatccatcattcgggcatttagctcttgacacaatgttgccctccccaacttctgtctcactggatatctttagattaaagaaataacataaattttgcatgagacttttcgaaatcatggaagagtatgccaaaaatccataacattaccattctttatagtcaggtttttattatagaaatcaataagaagcctagtacacgccaatttcacctttgaatatgcatgtcaaaattctaaatcaacatacaaacaaaatccaatatcacattaagaaaataacacgacatgaccaagtagggtttatttattctgggatttcaaggatcactcaacattagaacatctattcatagaattcacatattactaacagatataaggacaaaaatgtataaaaagctttagaaaatagttttatcaatcatttctacttgtaaaaacaaatacactaaaataggggttcttattcaggggttctgcaagatcaaaattatttccataaagatcggaagccatcactgccttgttctcagaaatatacagtagattttcccagatattgtgatgacatgtatatagcaaaggaattgaatggagaaagagataggtgaatggagctgccttctagtaagcttatgattaaagtgatttgcaaaagtataaaacagttccactcttcctgctaattttcctttggaaaatgtgccaatttttcattaaaattacactgattattttattaagtgattggtgtcctattgttatcttacatgaaaaaataaatatttaaacagtccttggttttactgttgagtctgataaatgctaatagataaaacttgtataagcaaagacacttcaggacacacaataatttttaggagtgaaaaggaataataagaccaaaaaataataagaccattttcaaattttcagaatttgaaaatgatagctgtgtaagatacaaatgtaaggtccagtttcttaattctatacatagttcctttataaaagatacagcagaaaaggaaatctcatttataacgagaggtttttttttttaagaaagaaacctaacaagaaatgcatgagacatgcacaagaaaaatctaagatgctcctgaataacacagaagttggtaagaacaaatgcttaggatgactcagcttcagaaaaaaactcaattctcccaagttttctataaatgtataacatttgaatgccaaaaagggttcttttctggtgctagacaattgattccaaagatcacatagcaaaataactaggaaaaacctaaaatgaagagcaacaagtaaaaggtgtattgggattgagagggtctagacttatgagacataaaacactaaaatccaaacagtgatgggcagaatgtgatatctccaacccagatgatgccttttaaccattttgttgcctgtgtaaggaactcatcatccatttcctagtacaggcctcgctagcatatttcaatgataattccctaagtcttccctcctttctttcatcctaattttttccagaataattctatcatgtggtgtgagatttccagagaggtgtatctcttaaacagatctattctactttgcctttaattacatgtttcattcaacaagttacccccttcgtttttcttggtttattgtaagttctaccttactcatcctaatggctttcctctgtgatctgttatgttaacctcagggcctggctttgagcagcatcctgagttagtggaaggaatcctgagctgcaattcagaacacctggattcattcctggctcctctcaaagaaaaagaagtcctgggggaaataaaacaaaactcagtctctctacacttcagtttccttatttatgaaatgaggacaaaattaatgccaactgatatggtttagatatttgtctcctccaaatctcatgttgaaagggaatccccagtgttggaggtggggtctggtgggaggtgtttggatcatgggggtggatccctcatgaatggcttagcaccctccccttggtgatgagtaagttcccgagagatctggttgtttaaaagtgtgtggtgcctcccctcctctctcttgctcctgctctcactgtgtgatgtgcctgctcaccccttcgccttccactctgattgtaagctacctgaggcctcaccagacgcagatactggagccatgctgccacagcctgtagaacgatgagccaattaaacctcttttctttataaagtatccagtttcatgtattcctttatagcaatgcaagaatggtcgaacacaccaacctaacagagtaatgtgaaattaagaagaaagtttatatatgatcacattccgcacccgtactggatttaccaagaggcaggaaggtgttgtgataaagagtatgggtcctgggaccagaacacctgccttcagtaacagcttcctcatttagtacttgtggaactttgcacaacttaaatgtcccatgtctgagattccttatctgtaaagagaaaagataacagtaaaggcatatctcattttattgtgctctgatttattgttcttcacaaatattgtgggtttttgtttttgttttgttctttttgcagattgaaggtttgtgacaaccctgtgtccagcaagtttactggtgccatttttccaatagcatgtgcttgcttgctttgtatccttgagtcagattttggcaattctagtaatatttcagaccttttcattattatcgtatctgccatggtgacctgtgatcagtgatgcttgatgttattgtcgtgatcgttttgggatgccacaggccatttcccatttaagatggcaaacctaattgataaatattgtgtgtgatctgactgctgcatcttccactcttcaggcttccctattttctgagctacaacaatatcaacatcaggccaataataaccctacaatgacttctaagtgttcaagtgaaaggaagagtcccaagtctctcaatttaagcaaaaaactagaaaatattaagcttagtgagggaaagcatgttggaagctgagataggatgagagctaagacttttgagccaaacagccaagttgtgaatgcaaagaaaaagttcttcaaaagcacttgaaaagtgctactctagtgaacacacaaatgataagaaagcaaaacagccttactgttgataggaagaggtttgagtggtctacatagaagaccaaagcagccaaaacattcccttaaaccaaaccctaatctacagcaaggccctaagtcatcaattctatgaagactgaaagaaataaggaagctgaagaaaaaaagttggaaactagcagaggttggttcatgaagtttaagaaaaggagccatctccataacataaaagtgcaagatggaagcagcaagtgttgatggagaagctgcagcaagttatccagatctagctaagatagttgattttcgatgtagacaaaagagctttctacaggaagaagatgccatctaagactttcatagctagacaggagaagtcagtgccaggcttcaaagcttggaaggacaggctgactctcttgttatcaggtaatgatgctggtgattgtaagttgaggctaatgttcattgatcattccgaaaattctagggcccataagaattatgctaaatctactgtgcctgtgttctacaaatgaaacaacaaatcctggatgacagcagatctgtttacatcgtcatttactgaatatttaaagcccagtgttgagacctactgctcagagaaaaggattcctttcaaaatatacccactcactgacaatgcacctggtcacccaagagctctgatggagatgtacaaggagataatgttgttttcatacctgctaacacaacatttaatctgtagtcaatggatgaaagagtaattttgactttcaagtcttattacttaagaaatgcatttgtaaggctacagctattgtagatgatcagattcctctgatggaatggggcaaagtaaattgacaactttctgcaaaggggtcatcattctagataccattaggaacatttatgattcatgggaggagtcaaaatcttaacattaacaggagtttggaagaagttgatcccagcccttagggatgattaagggattcaagagtttggaagaagtaatcgcagatgtggtggaaatagcgagagaactagaattagaagtggagcctacagatttgactgaattgttgaacctcatgataaaactcgaacaaagggggagttgcttcttatggagcaaataaagttgtttcttaagatgaaatctacttccggtgaagatggtgtgaacattgttgaaataacaacaaagaatttagaatattatataaacttagttgataaaacgaggacagggtttgaaaggatgtattccaattttcaaagaagttctactgcgggtaaaatgctatcaagcagcatcacatgttacagagaaatcttttgcaaaaaaaagagtcaattgatgtggcaaactttattgttgttttattttaagaagttgctacagcttctccaacctttagcaaccaccgcccagatcagtcagcagctatcagcactgaggcaagatctcccacaaacaaaaaggttacaacttttgctaaaggctcagatgattgttatcatttttcagtaataaagtatgtttaaattaaggtatgtgcattgttttttagacataatgctattgcacacttaatagactacagtatagtgtaaacataacttttatatgcactaggaaaccaaaaaatgtgtgtgatttactttattgtgatatttgctttatttctgtcatctggaatttaaccccaaatatctccaaggtatgcctctactacctgtagttgttgtgattattatatggtaatttatataaagtaccaggaataaaacctggtacctggtgaatgttctctaggcactaataaactaactgttattatctactgcccatctttttccccaacttgatgaagacagaggtattgattctccaatgttgcctctgctctgtggaaaagaacttcagggacccaagaatatagaacctcaccctttcctctcacaatcaaaggtaagtaagagccaaacaagacaaaaaggaaattatcaacataaacattactttcccctggctctaaggcacacaagcagcaactcaagctaagggattcctgggggttttgtgttgctctaagtggcacttttctgaacagtgaaacttgatgaaggaaaagaccaattttaagtcatctggatcacaaccaacattgtctgtgattacccttgtcagtgtgtgttaagaactggtggtgaaatatcaagtattaatgaaggttgctaagtaaccacacaattacataaatcttttcaagtgcatttttgagtatttttaaataatgaggtaaaatgtaggacatcatatgaataactaaggtaatgcaaccacatgcatgtttaaagagatttctaggcctgattttcttagaaaaaaataagtatagtatttcccagggaaaatattgtctgtcttggagaatgtatcagttgcaatcacttctcttaaagtagtaaataaagaatagttttatcagaaacgactacaggggaatacagacatttttagaggaattgcttcttcaagataaccaagcatgttagcaacatgaaataattatagcaaaaattatattatttacattatgataacactctctcaacgacagcgtaagatacaacttcttggtccagattaatacgaaagctacattcccaacatttgagataatgaagccaatgatgggaatcatttgaaaatttaacaacactcctcacagtaacaatagtcagaagaacagacaatatcacttgcaaaaattggttcaatctgtgaactgataaaaggcagcagtcattcattacatgtactaccagatttcaaagcatgttctggccgggcgcagtgactcacgcctgaaaccccagcactttgggaggccgaggcgggctgatcacgagggcaggaggagaccatacgggctaacacggtgaaaccccgtctctactaaaaatacaaaaaattagccgggcgtggtgcgggcacctgtagtcccagctactcaggaggctgaggcaggagaatggcgtgaacccgggaggcggagcttgcagtgagccgagatcaggccactgcactccagcctgggcgacagagcaagactccgtctcaaaaaaaaaaaaaaaaaaaaaaaaaaaagcatgttcttcattttagaaatggcaaatatatgaaaatccatgctgattacgaaacatacaaaaaacattcaggaatgttctcttgggaacacttctggaaccccctttctggagctatttaagagaaatgtcacatatacatttttgaggctgaacaaagataataattgatagagacaatttagatgattgctttcactgtgtgacaatcacaccctggtcttaaataccacatcactggctaaaagagaatcaggcattaattgcacgtgcaagatcacggactttgatcatgggaaaagacggtctaccaaggagcaagcttcactcttgataatacaactggaatttaaatctcaaactttttttctcccctcttggtcatctattcccagtttgcttaatgtcatacaaatctgtaatgtatccaatttaaaaatttgaattcagaaaaaagcgttatgcaccatctctttttattaaattggctggaatatgatgctctcaaatttcaatccgagttcctttactcaataacactccaatttcaccctctcctaatgcaaagcactgaatagtaggggagaagatccaagtaatgactcaggaaaggagacgctacgcctcgtctggacttttcagacggcagagatctccctgccatgtgatgccatccactggacaattagaaggatgaaaacagttttcattcagacaaaatctgcctccttttatccaaagcaaagcaggctaatcttactcctttttccaatgacagctgcttaaatacttgaagacagatgagtaacagcatctaacttctctgccttaagcttaatttttcatgtcctctcacttactttagtacttcacatcccctccccggcctacacgggttgttctgttcactctgctcaaaagatgggcagagtttctacatgttgtcccctaagtatgcagtgcttgggatgggataccatacactctgtgtgttctgactatttccaggcatggcagaagcatgcctaccttcatctcggacgttacaggccaaacaggaggatttaaggatactttatccacaatttttcagagtataaatgtgacatctctttatagaaaattaaaattgcctatgatatcaaatatcccagaatagttacaatcaatattcagtatattgtctcttaactgtttctctaggtatctatttttataaacaaaattgggatcatattacatataacctttttttggatggtagaatcattgcaaacaatataatatttatttattcactcgtttatttaacaagcgcgtccatagattacacatgctgttgcattccagcctgggcgacagagtgagaccatgtctcaaaaaaaaaaaaaaaaaaaggagaaacaaagaagaaaaggaagaaattatctaaatttcttatccaatttcttatatttagataatttcttatatttagataatgtcttccttttcttctttgtttcttcctttttttttgagacatggtctcactgtgtcgcccaggctggaatgcaacggcatggtcacggctcactgtggccttgacctcccgggctcgagtgattttatttcacatttcagcatagtttttctccacatctttccaagtctttaaaattctcattttgagttatacaatatactgtcttgtggatatatcttatttaaccaccccggtaagttgaatagctatgcgatttcaaatgttagctaccctatgtttaaccactctaattttattgtatagctctggacaagttaatctacttgtgaaaaagattttatctttttaattcatattgtcaaattaatttttatacagataataccaatgcacacacccaccatagcatttagaaacacttgtctttctattgctcttgccaggattgcatacaattaatttgaaattttaaaataaaatatattgaaaaaaattgtcatctctttgtcttaatttatgactagaaaggttaaactcttttcccaatttttaatagccatttatatattttcttttatacatggtcagtttaagccctttatctagtttatgtgaaatcatgatatttctgaattgtttaattattttatacattcagaatatcaaaatttatttatcttgctccaagtattttcagattatctctatgcctttcaattatatttttaaacacaaaatcaagtttttaataaaatgtattagcccgcttattttgtgatttattctgctgtctttatgcgtgaaaagttctctagatcctaacattagctcaacgtaaacctctgtttcaaaacagctatattcatagctctactatagatctcattatagtatttgcataataattattcatttacacccccgttctacttattctggactctgagtatctcagtcactggggcagtatttttcatcctcttctctttagcctttagtgtgggaaactataaatgttggttgaaagacatactaaatgaatgaatcaactgtgtaatgcacagatttttttcagtgaaaatcaaagaaatgtaccactttacttctcttattcctttttttcttgccaaactattgtatgaatagtatagttagaaaaatgtattccacaggaataacgatattttatcatatacttgtttgtttaaagtacacaattaatatacaatcatgcctcagaacaacatgtggggtgtccatacaaccgtggtgcaactaatccttcaaaagataattttgaatttttagcattctctgaagaaatattttgcatgtatcaattctcatccaggagaaatcaatggcaggatttctcacaataatcataaggagaaaaatatttctcttatgattagtgtgatttttcagagaaaaaatatctgagtcatttttgtgggactctgcttctttttaaatcacattgatcatgtcaagaatgaatctaccaaataagacaaacaaagccaagcacactgagtaaagtagagaaccaatacatgggctttgtattttacttcaaggtcttgtctatatggcatacaaagacacacagtggaacaaccatcagcttttctatataggtggacctgatgttaggcaagtaaaattcactttatctgctgatatcaccacatgacgctgttttgttcttgtggtcggatattttgttgagttcattatactctcctatgatgtgccctctgtttcactttgtaaaaaagttatatctctatttttttttgttatgtcatggactttatttttgagtagtttaggtttacagaaaattgagtacagagaacagagaattcccgtatgtcccctcatcccaccccaaagtcccctgtattattaacatcttatattgatgtggtacattgtttcagttgttgagccaatattgatacattaatagtaattaaagtccagagcttgcattggggttcactcttggtgctacatacactgtataggctgtgataaatgtataacaatatgtatccaccattaaggtatcttacaaaatattttcactgtcctaaaaatctgtgctcttcctcttcatcatccctgctttcccttcaacccttcatctttttcctgtctctgtggttttgccttttccacaatgtcatagagttggaatcatatgataactggccttctaagactggtttctttcatttgtacgatgcatttaaagtccttccatgtctttttgtggcttgatagctcatcccattctatcattgaaaaacattctgatatggtttggctgtgtccctgcccaaatctcatctgaattgtagttcccgtaatccccatgtgttgtgggagggacctggtgggaggtaattgaatcatgggggtggttacccccacgttgttctcatgatagtgagtgagttctcaggagatctgacggttttataaggggcttctcccgctttgttctgcccttctccgtgctaccaccatgtgaacaaggacatgtttgcttccccttctgccatgattgtaagtttcctgagacctccccaaccatgctgaactgagtcaattaaacctgtttcttttataaattacccagtcttgggtatgtctttattagcagcatgagaatgaactaatacaccttccattgtatgaatataccatagttattttttgaaggacatcttgattgtttccatggtttggcaattatgaataaagttgccataaacatttgtaggtttttgtgtgaacagaactttcctattcatttgggtaaatacgaaggagtgggaatgctatattgtatagtaacaattcatttagttttataggaaactcccaaattgtctttcaaagtagctgtaccattttgcatttccaccagcagagaatgagagttcctgatgttccacatcctcaccagcattggatgttgctagtgttttggattttagtcatgctaataggtgtgcagtggtatgcaattgttgttttaatttagccctaatgacgtgatgttgagcatctttttgccctctgtgtatgttttttggtgcagtgtctgttcagatcctttgtccatttttaattggctgttttattactattgttgagttttaagagttatttgtatattttgaataccagtccaaaatatcagttgttttgctaatattgtcccagtctgtggcttgaattctcataacatcttttatagagtaaaagattttaattttaatgaagtctaattcattagtctttataatatggatatatgatttttttctttttagcctgtagaagtaatcaattatatcaattgattttcaaatgttgaaccagtcttgaatacctggaataattcccacttcactgtggtgtaaaattcttcttgtacaacgctggacatgatatcctaatattttgttgaggatttttgcatctttgttcatgagagacattggtgtgtagttttccttccttgcaatgactttgtttgctttgggtattggggtaatgctagcctcatagaatgagttaggaggtagccactctgctattttctggaaaagattgtaaagaattgatataatttgtccctctttgctagaattcatcagtgaacccatctgggctggtgcttcctgtcttagaaggttattaattattgattcaatttcttcatttaatttactgttttttaaatttttgagacagggtcttgctgtgttgcccagactggtcttgaacaactgggctcaactgatcctcctgtctcggcctcccaaagtgctgggattacaggcatgagccatcactcctggcctaatttctttaattgaataggttaatctttaataatagatgttaagatgtaggccttctcattaatatatataggcccatatatattatctattttcttggtaagttttagtacattgtgtttttctttctttctttcctgttttttttttttttttttcttttggtccatttcatctaggccttcaaatttctgggcatagagttgtttagaatatttcattattatgcttttagtgtcacagaatcagtagatatagacccttttatatttctgatattagtaatttgtgtcttctccctttattccttagttaacctggctagaggattattgactttactggttttttccaaaaaaagttttgattttattgattttctctatattctcttgccattctcattgatacctgctttaatttttatcatttcttctcttctacttactttggatttaacttgttctcctattcctagtttccaaatgtggaagtttagattactaattttagatctttctttcttctagtacatgtactcaatgctataaatttctctctaagcactgctttcactggatcctaaaaattttgataaagcatatttttattttaagctagtttgaaatatttttatatttctcttgagactgcttctatgacccatgtgttatttagaagtgtgttgtttaatctactagtattttgagatattctagctgttctgatttctagttttatatcattttggtctgagaacatactttgtgtgatttctattctaaatttgttaaggtgtgttttttgacacagagtgcaatctcttctagtgagtgctccatggaagcttgagaagaacgtgtattctgctgctgttgtattaagtattctatagatgtcagttagatccagttgattgacggtgaacttcagttaaaccttgttcttagttccttactgattttctgcctgcttgaactgtaaattactgatagaggggtattacagtctcaaaataaaatagcgtatttatccatttctccttgtacttctttcagtgtttgcctcatactttgatgttctgttgttaaatgcatagacatcaaatattattatgtctttatgaagaattgatctttttatcattatgtaatattcctctttatctctgataattttccttgctctgatgttggctttgtctgaaattaatctagctactccagctttcttttgatcactgttaacatttaacttcatattttaatggatttgtacacacacaggcacacacacgcttgcttcgccaggctattctatacaaatttatttgaagaaaaatagatacgtagggacatttatgggactacaggcaagatagaagaaagacaagagaccttccaaatgaataacaaatcctctttcactctctatgccttcctctaacaaactgaccttgtatcagggtttaactattacctttagcttaatgagtttcagaatcaattctatatcccaaaacatccctcaaattttggtctcatgtctacaactattgacaagatctcgctccatctgaatgtcatgtcatcacactcagcatgccctaaaacaaactcactgttccaaatctgctacgaacccttagcaaaatcctttgtaaatttcatatgtccaccattttctcaactactcagactcaatattttgcattaagttgtatgctacaaaatgttaggtttaggatagggaattgaagacagactttctgctcttcaagagatcatggtctgacagatgttaaaacaagtgatctggtcagggtcaacgaaaatgctacaaaatgctgattatatattggttttaaaaagcataaataaatcaactattctcactactttgtgattaggatttgcttaaattgaagtcaggaagaattcaatgattattgtttctatattgaacattctgatgaagtacatttccatttctctgcttaagcatttttatccgtgacgtctttgttgaatgcttggcatgcattcaaccctaaactaatagactggggaagcaaagaaggtgatctaattcttattgcttcagtgctggaaagaactctaaaattatgaatctcattttctatccagtgattgccttttctccattctgtttctggctcatgacttctaatctacttgaatttatcatttgcatcattagaagttggcaatgacctttagatagctttgagtattaggaagcttttatattgatattttattttccagtcattttcatagtagtcatacagaacccaatgtgtggtaaaccaataaactttattccaactctgtttaataacatttcaaaataggaagacactttccatgggaattctcattcctagggtcactaatcttattaataatttcacaatttttttttgttcttgcttttttttagtttgcctccttaccgtccatccattcacctcttaactccagctcatccacattctttttaaagtatggtgcagaggattgggcacaaaatgctaaaattgagtttcttcagcactttgacaagtagaagtttcactgcaatttagctagatgttaaaatcctgttaatacaagctactaacgcattattctttgtgtgtgtatatgtgtggggcttcattaaattattgaaacattaaatacacaagtcaacccaaatactatattatctttgtcatcctacaatttggtgtatttctcccactatattcttcagtagttagtttctggcaattctgtctggagtccttagtaagttaagagtcctttttagtgttatgaccttaatttttttttctggagtaaatgttgacatacttaggaggctaactttattttatagagatattaagtactagaatgattattctgtgtcaatccgacctaaaagtgacctcatggttttttgaaaggtaaaaaatcatattatgtatattttctacactctaggtaaaatgcacataatatatcatattttacattaaattgactttaagtatattttaaagattctgaactgttatttcaaatttccctttcctcactacatttctggctaatggcttccaatccattcttgaggttggaataataaatgctcgtgtcaaatcggatcaaataaaagtattcaaaaggcaaggtagcatatcacctttacttgaattaaaagctttagaaggatcaggtgttacctggtttttttttattgaaaggtgtaatagcagaactgtgaaagggaaaacaaaatgaaaaacattcaacaaaaatgctgttaggataactccatttctggcttttgaaaataaagatactttatatatttatgaaggcaaatcgattcaggaaaatataatgacataacttaaaagtctttcagttagatcgtgtcacagatctgtgatatttaagctttttattctaatgggaatatcaatctcaagacttttaaaattgatagtgattgcttcatagtttttcaattaaccttctgaaaaaccataacaaaaataagaccctactttcttatctctttttttttacgaataatttctgtaaactaaatatgtgtgtgtgtgtgtgtgtgtgtgtgtgtgtttgtgtgtgtattttagagacagggtttcactctgctacctaggctggagtgcagtggcatgatatagctcactgcaacctcgaactcctggccgcaaggaatcctcttagcctcagcctcctgagtagctaggattataggcatgcaccatcatacctggctaatgttttgtagagatggaatctcactatgtcgcccaggcttaaatatagtttatatattttaaaaattttaggccgggcacggtggctcatgcctataatcccagcactttgggaggctgaggcgggaggatcacttgaggcctggagtttgagaccagcctggccaacatggtgaaaccccgtctctactaaaaatacaaaaaattagctgggcgtggtggcatgcgcctgtaattccagccattcaggaggctgaggcaggagaattgcttgaaccggggaggtggaggttgcagtgaggtaagatcgcaccactgcactccagcctgggcgacaacgtgagattctgttttaaaaaacataaataaataaaaataaaaatgtagatcctttttgaaataataacgtatgtaggttgttacacaatattatcatatctaaatattgaagataggacttatcaggcagccctgttggcaatagccctctagggtgtatattgtataaacatccctggcaggggtattctacacatgttagttggattcccctaggtcaggggtgtgtggtctataatatatgaaaaatgccctgaactctggacttttaaaaacagcaaaaggatatgtgaaaaccgttttaaaataccattttaaaatacaacaagacacctataaatacagctattttttcaaaagcaaaaggacatatgaaaaccatgagtaaaatataataagacacctataaatacagctatatcctctgcggactattgcattctatttattctttctttttgcaggatagatacataaagtcaggatctcattcttgctggagctacttacctgcctggacccacaccaccccctagttccaggcctggctctcccaccgctagctctgaacctgagtacgtcctataaacaacatgagcatctgtatctcccttcagaaaacaaatggtgcagtcatactcatcctgctgtgttaatgactatgttcataaaatgcgacactggactacgagttttaggaatcaaggagtgtgttttagtccactctttatgactggccttagtataatatctggcacatactgatatagaataaaaggtatcattacatgatacctttctatattatatccacatgtatcccatgatccatgttccatattatggaagggtggcaacgccctgtttcacgagtttcagattcaacttttgaaggaaacatgttttagtcattgcattggcagatggctccaggacttacatatttaaataacaaaaatgttggggataaaagtattccccaaacagttcaaaaagtttcataggtgggtaaaggaaccatccctttgaagaggaaagtcaacagtctgacttatttcaggtaaacaggttgataaagacaaagaaaggctgctttgttctaagtcttgcgttcctgcacctagaggacagatcccacattccagaataaaggcttaaataaaaatgcaagcatacaggaaataaaagagttcaaaaataaagggtactaagagagaggggtcatagattagcattaacaccatggtgaccacatcagccttaagtcaaggtcagactatttcatgcaagttatccctaaatggaagagtggaatgataaggctggaggaaaaaagagatggctatgggagtggtcttcagagttattctggttgggacctcagaactgaagacaaaggttgtgatgctccttgattgtcctctgtgagattcatagatgtcattaaaaccatgaagtacaggagctgcatttgcattatctgtttccatattccattttttttttgctttttcctttttttttgctactctctgtttcttttcacgaagaaagctgaaaatttattgtctttcacctgtcaagtgagatgctaaagtgatctgctagctgcttttacccatataatctcatttaatgttcaactaacactgcaaggtaggtagatatatttccattttataagtaagactgctgaatcttagaaagggcaaatcactgtgcaaggtgggcctcgtaaataatggactcatgtctatctgattccaaagcccacctgcttcccactctgccccaggtctccctattcccttttttactggttgttggctgacataataaaaactggaagtgtacacaataggacagtctcttagatatggacatcttctggtgaggggcggtatgcaatatcaggccccaggccataccagattaagcctctggacagtttgagatactctctggtattttcctacacgtggtctgggattctacgttgctcaggaggcaataatttggtgttaacatggaagacctagcttcctagcttcacagatcctgtctagaagacacttaaattttacagtgaatactacaaggtacaaagagtctttcattacagccacagtcaggacagactatgaagaagaaactgagctatagaaatacctattcactttaactctgggatataggatttagggtctaaatatattaggattgattatgacaactgcagaattcatttctagggacaaatgtaaaagtgtagacattcttagaaattatcacaatattgctgttttcccctatgccactttttcttgagggggcctagttaccttagaaagttcttgtcattgcttagctaacactacagccagcaaatagagatagagcttatgtgtttggctgagaaaataacataggagctctcttaggagaacctttctgttaatgtccctgtcatcatcatctttgtctattaactcacagtaaggacccaaaagactaaaaacaagataaacaccagtacctgtatggcagacacagcctttggacaagtgtcagcatttcgcaagtgcctgagatcacttcaaaatgtttaaatttttaaaatgccaagagggattacctctaaagtaatacaggaagttataatgttaagaaaaagaaatggttgaaggtaggattggttttaggcgaacgccattctcagaggctcatgacaacccgaagctctattttcctctagaaaataagggatgatggccgggcgcggttgctcacgcctgtaatcccagcactttgggaggctgaggcgcgtggatcacgaggtcaggagatcgagatcatccttgctaacacggtgaaaccccgtctctactaaaaatacaaaaaattagccaggcatggcggtgggcacctgtagtcccagctactcaggaggctgaggcaggagaatggcctgaacccgggaggcggagcttgcagtgagctgagattgagccactgcactccagcctgggcaacagagcgagactccgtctcaaaaaaaaaaaaaaaaagttcaacaagggagatggagccagtggcttctgggtggtttctgcctccagatcctccttgggatgactttctagttggaagcctagtgaaggatgtggtggaggcctcttggataacactcatatgtgctccttgctggtgggagacacgaaagactagcgcccgacttgcactggatagagggaaagacaactttgatcagattctgcctccaacagaggcacacaaagggctaaggcaatggagcaggggagtgtttgaggtgggatcatgtgtcatctctgtgagcatgagagtctcagagcatgaaatagacgtgggcagtgcaggggagctggcatggtgtgagtccttttgggttgccaggaggatccaggtcatggaagctaaacgaggctagagatgagccaccagatgtccaggggacaaagtggataagcacaggaacataacacattgactggtttctagaggttgcttaaaacaaacaaaaaaaataaaaatcctacttaatgtccttgcaatagctatgcacctgacctcataatcctttttcttcatgaacaataaaactcacactgaattttcagtagcaaagccagttaattctcagttgattctctttgaatctttccagaattcaaaagagagaacaaattcaatatagcatttaacaattacattgctatctgaagctgaaatatgtacatatataaacaaacctttggagactttctattttggtctgactctgaaggtagttgggagaaaattgtaaggtattcttatcaatcttgatttgtctttcatgctatgaacctattatttattctaataatacttatataaatattattctctactgccttgtctgtatttaaataaatctacagaagaaaatgatacagcatcaaaatagaaggaaatatacgaggttgtcttatagttgctggtaaccactgtttaatttcatccataaagttttctggtattaattaaggatattcattaatattactctgaggcacgtagtttaacattaataaggaagaaagccagctaagttattagagatccaatgttatgtcattaaaagtgtgagctgatttgaatttgagccacaggaaatgaaagtctgtgaaagtcaacaaccaaagcaggctactaataggttttaagaaagaaaatcaggctgggcacggtggctcatgcctgcaatcccagaactttgggaggctgaggcagacagactgcttgagctccggagttcaagaccagcctgggcaccatggcaaaactccatctctatcaaaaatacaaaaaattagccaggcttggtggcacatgcctgttgtcccagatacttgggaggctgaggtgggaggacggcttgaactgggaggcagaggttacagtgagccaagatcatgccactgtactccagcctgggccacagagccagatcccataaaaaaagagagagagagaaagaaagaaaagaaaagaagagaaaagaaagaaagaaagaaagaaaagaagagaaaagaaagaaagaaaaagaaagaaaagaaaaagaaagaaaagaaaaggaaagaaagaaagaaagaaagaaagaaagaaagaaagaaaggacggagggagggaaggacgaaggaaggaaggaaggaacgaaggaacgaagggagggaaggaaaatcagggcaggaataacacttgtactatgaagccagaaaaatgtaaacaataaaacatgaaaaactgttttgttgcagtagtttttctttcaaatgtatacagaagcatcagataccttcaaatagcaagagagtaagcaagcgatatcatggtgggaaaatgcatggttttataaattaaatacgatgctattgaggtctagtcatcctacacaaaagtggtgatcttttcttaatgaattcaccaagataccatggagcgtgcatggggtcactacagtctttcacttactttggcagggcacccctcacttcccacagacggagaagatggattcaagacgagagtgcgacgcttgcttaccacgggcctgtgcacgtcccagaacgctctctcttggctgtcaaggatcttcctttcaatcttgtctctcttcttgtccactctgtcaacacagtaacaatagataacatttagtattaattgtagtgcctctctgaacaaaaaggccacaactggaacaaatcttccaaacgactcacaaggactcactttgcttgtgcttctgcttgcatgaaaatgaactcccacttccgggcaaatgctctctgcagcctggccaggctctcctgaaaaacataccccaggtgaagacatttggtgttcattgtcactgctctcttctagcttagttaccacttgtatttgtcaaggaaacaaatagagagtttctaaagccctaagtgtactgtggttctcaatgataagtcatgctccctgaattcagctcatcttcatattggcagtcttaaaggaagcagaaaaacctgttacaaatatcgattttttgaattactgactttggagaacaggactacaaacccaatatgtatctgaaaaatactaaaattacctagtacataaggaggtgctcagatgaacccactggatttttcggtacccactttatagaggaacagaacatcagtacattcctactacgcatgcaatcagcctattcagttcctgacaatacatggcacaccctggcggcccacaacctattcctacacagtgctttgaattcagaaaatctaacatagcaaccatctgcacaaatgacagcagatgacttttatctgctgaagatcactgtcagcagagacaattttggcaaaacccactctttcccagggtaaatggtctttaatcctcagagtttggatatcttcactatgtaggatgtatctgacatttcgacagttaagtcgattttagaaaataagatatgcttcccttttatactttgagtttatgtatttagagttttgccatatgcaatgtgaatgaagagaggaagtaagcaaacagggattcatgcacccactgtgatgccagatccctagaaatctgacccttcagatccatgaatgaggctgggcgtggtggctcgtgcctgtaatcccaacactttaggaggctgaggcgggtagatcacctgaggtcaggagttcaagaccagcctggccaacatgacgaaacccagtctctactaaaaatacaaaaattatctgggcgtggtggtgcacgcctataatcccagctactccagaggctgaagcaggagaatcacttgaacctgggaggcagaggttgcagtgagccaagatcgtgccactgcactctagcctgggtgacaagagtgaaactccatctcaaaaaaaagaaaaagatccatgaatgaagagttaacatcctgcccagaaaaggctgtgggccttactgctgtgcattctatgactatctttgccagaaggtccttggtacttacagcctcatagtctgcgagctccagtcgtgccttgttttgcattgttctcttgcagaggtaaacggctgaaaaaaaaatcaatcatttcttgcctgcttatcaacaccatggcactataagtaaaagtacaacattacaaatcaagggcattgcacttttttcccaagttgtaatttttgatcattttcttagacaaaaaataattatgtaataacattattactgaaattcaagcatcatagtatttatgataccctaataaaataaatatgctaagaaacttggtaacttttttttttcagagatggtcttactctgtcaccctggctgaagcaagtgtagtggtaagatccttgttcactgcagccacacactcctaggctcaattgatcctttcgcctcagcctcccgagtagctgggactataggcgtgagccaccaagcctagctaattttatcgttattattattatttgtagagcagcttctcgctttgttgcccaggctggtcttgaactcctgggctcaagtgatccttccacctcggcctctcaaagtgctgagattataggcatgagacataatcatttaaaaatttttattaaatggtcatcacagtttttagcatcttcaacaaataagaggagaaaacaaaacctcctaaaagggtcaccaaatgaacttaaaaatctatatatccaaataaaatcattttgtgaaaaggaaattatgaattagtggcacattcaacgatgtccagattctactgtcaactgaaacaatctgttcatgtacactgaagacttcttgcatcttcttggcttcatttcacaagagccaatcttccatcgttttgtcactaggagaagggtatcacatcttacctaccttccacagtatttccattttcctgaggagtcgatggcctgggctaccatggaaagtccatctgggcagcagatttataggagaaggtggtgacagcagtgttgcaattgagcaaatttcttcaattatttcagggtattccagtgactctcatgacaaactcaaggcattcacagccctctggtagagtcccaattgccagaacatttttgtcattgtttttcactaaatatgcatgatatttgagtctcatgaaactcaagatacattgtatctgttctagatgctgagtaaatgcattggatgaggactgtcaaatattacttattgtaagtctacctctgtgagtttgccttggaaatatcacctttgcactacacttaccaccccaagttttggataacgacgtccagctggtatcactaaggaaacacactacacagaaaatttaagaccggtgcaaacaggaatactatttactcaatttctgtaaggtttcctgtatgaaagtcaagacgaaggagagagccaaccacagaatgatgctgacattcctacaaatgctaagaacccagtatatagtattagaacacatctttgtacaatctaccataataattttattgttctactaatattagtaatttttaaaagtcagacttcataaacaaaagtgacatgatgtgttcatttcctaattcatcataactgatgctcactcccgaaggatctcttactatagacgccactgtgacttgaataaaatatctaaaatgttctaagcagttgtaaaagaaattgaagcgtaagtgaaatacccctgagggtgtctcttcatgagagaaagatcaaattttcttaaatatctaattgaataatttcagctttcctgtggaattacctctgatgaaatttcaagccccagctatgccctccatcagtcacacctcctgtgtcctcctgcatcagcttctccttgctttattggttttgcccatctaatctttattatttgcaaaatcagctccctttggggaaatgtttctcaccattaggtaccctaatgccttaaagcaagagtgggatgattttattttttacatgactgctcacaaagacattatgtatcttgtaatacaggtgtcctatgatgtgatttttctttaattctctagggaaaaaaatgaaggtgcgggcagacagtgccaggcataaaatattggtatcacaaatatttgttgaatgagtgaattaacaaatgaatgaataggatatcttcagaaggagctatttcgaggtcaaatcaacttaagtgataaaatctccctaaatgtctacttgattctttggtataaagaaagacaggaagcagggcatggtggcttatttctgtggtcttagctacacttgggaggctgaggaaggaggatcatttgagactagtagtttgaggctgcagtgagctatgattgcaccactgcactccagactgggcaacagagcaagactctgtctcttaaaaaaataaaataaaataagaaagaaagaggcaaaaggtacaagtctgagttagcagtgtacagaataatctggtaactgttgaagatacagcaaatatgctcttgaccggataggcccagacctcatcagtctagtccagacacagttgctgtatgatgacaggtacagataatactttttattctttattagcagagagtatcagcattggtcaagatgtggatgaggcagaaggtccaagtagatcaaagatgattccaattcaggaaatttcccaattcattgaagactgacaaaatgaatgcactcatgcatagtcaaaactacagctcaggctgggcacattggctcatgcctgtaatcccagcaggttgggaggccgagatgggtggatcacaaggtcaggagttcaagaccagtgtggccaagatgctgaaacctcgtctctactaaaaatacaaaaaaattagccaagcatggtggcaggcgcctgtagtcccagctactggggaagctgagtcaggagaatcacatgaacccaggagacagaggttgcagtgagccaagatcatgccactgcactccagcctgggtgacagagcaagactccgtctaaaaaaaaacaaaaacaaaaacaaacaaacaaaaaacttcagctaaggcaaggtgcttttgtgccaatcctaattattttggcactgaacatgctctatatggtgctaggtatagacctaggcccagacccaaaagagtgaatcttttataacataaccccgaatatttcctgctgtgatgaaatattgaaaatatcaactaatgatgccatttttggggttctatttaaaatattttctattattaaagatgtaatttcaataccaagtttaaatatatctccctgcagtagttttctgggagatcatcaggagacaatttggaagacttgggaggtcaaacaagtaatttaacaggaggctatgccactaagtgggagaaagtttgggcaggcctgaagtgctactctggctaagaaagctccatagataaggcatagattttggcccaaatgcaacttagaacttagatggaaaagtcaaagtttctggatcccatctttgagtagaaacagaatagaaagtgagtgctgacgtcaggtcttcccctttaatttataaagctctagagaagctggagtggtctctcagacaacactgatgcccatgacaaaggtatgaaagcacatcacacaggtcagcgagaaaatcactaagaccccagtatcaaaatgtggaaagagtaggaatatatcattcaccaagactagaactacaaaagtccaataaatattttaaaattacccagcttacaacccaggtaatgcaaattaacttacattgtcatgctattcttttttttttctcttttaatgtttagtttgtggctaattcttctcttgttcctgaattttaaacagtcaggcagtttgtacaatcttccttctcatgcttgagtaattcaaagagtcccaagttatttgagagatgattgggtcatgaggatggaaccttccttaatgagattagtgcttttattaatagactcgaaggaggtggttcacccttctaccatgtggggacacagcaagacagtgccgactatgaaccagaaagtgggccctccccagacatcaaatcagttggcactttaatcctggacttctcaacctccagcattgtgagaaataaacgtttgctgtttataaacaaaacaaaacaaaagggtaccaagttattaatgagaatgttcatctcaagtaatgatcaaataatcatgcaaattgtgggtgagaagaagtgtgagtggcttctttctcccctccccaactcccttttgtgactctcaccaagaaccatgaactgaggcctctgatcctcctggggctggagtgtaggagaggaaaggggaagactgacatttttattacatttttcattggaatagaactttattatatttgatggagattttgaattttattgctgagataaaaaattaaatctggtatgtaacaaaaataaatatgtgcttcacaggagctttcctttattattttaacattaaaaatttttaaaatattttagttgataaatgagaaattgcatatatttatattgtgctacgtgatgttttaatataggttatacgctttgctatgactaaatcaagctaattaacatttccgtcacttcacattcttaccactttttgtgatgagaactttgaaaatctactctcggccgggtgcagtggatcatgcctgtaatctcagcagtttgggaggctgaggtgggcagatcacttgagctcaggagctcgagaccaacctggccaatatggtgaaaccctatctctactaaaaataccaaaatttagctgcgtgttgtggcgggtgcctgtaatctcagctactcgggaggctgaggcaggagaattgcttgaacccgggaggcgggggttgcagtgagctgagatcccaccattgcactccagcctgggtgacaagagcgaaactccatctcaaaacaaaaaacaaaaaacaaaaaacaaaaaactactctcttggcaattttcaagtattaatggtaactatcatcatcccgctatacaacagtcttccagaacttagtcctctaactgaaactttgcgctctttaaccaatatctgcccccactgcccccaggccctggtaatcaccattctactttttgcttctatgagataaacttttttcagattccacacgagtgacatcacgcagtatttgtgtttcagtgcctgacttatttcacttaacataatgtcctccaggcgcatcatgttgctgcaaatacaagattttttgtatttttaaaggctgaatagtatttcattgtgtatctatcccacattttctttacccattcgcctgttgctggacacttaggttgattctgtatcttggctattgtgaataatgttgtaatgaacgtggaagttcaggtatcacttccaaatactgattttattttctttgggtagatccccagaattggaattgctggatcctatggtagttctaggttcattatttgaggaacttctgtacagttttccataatggccgtactaatttacattcccaccagcaacagtgtatcagggttctcttttctccacattctccccaacgcttgttacctttcatcttttcaatcaaagccattcttacaagtgtgaggcaatatctcactgtggttctgatttgcatttccctgatgattagtgacggggaccaccttttcacatacctgttggccatttgtaggtcttcttttgaaaaatgtctatttaggtttcttgctcattatttaattggcttattcgtcttcctgcttcattgataccaccagggtgatctagcttgccactctctagacttggcaaaagtttaaagctccttatgatttttacggtacctttagcctctctctatgatgctgtttgcccctccagtctgccatgtaggacaggactgtctcacacagggtttagatgatgcctaagagaaacattcacacattttattttttgccttaatagaaggctgcagaacagagccacctccctttcaactcttccacccatagctagacagcctgcctcttgcccttcagaatcccatggcctacaagtctgtggcctattgtgttcccaggggtgcgtgactctcatctagcactctcagcagccccttgaagtctcttatcaggagtgagataaggcgcggtcacccctggctccatccactcagggctggtggaagcaatggctcccaacatcctatggattccagactcggtcttcaagacaatgccttgcccttagacccttgatgtgagcagaaagcaattactgggatcatgcatatgttagtggaacacagcccctttacacctgatcttgacccacttaacactttggctgggtttccatgttaacatcctgttacagaaaccattttccactcagcaaaacagcagagagtttaaaggggaataatccattctggcaaaagaagagtgaaagagagctgctggtgggcaaataaacaggggaaagtctccttggaaaggacgtgagagtgagtaataaagccttaaaacattcatggccataggctgggtgtagtggctcacacctgtaatcctagcattttgggagctgaggcaggcagattgcttgagctcaggagtttaagaccagcctggataacatggtgaaacccaatctctactaaaatacaaaaaattagctgggcttggtggtgcacacctgtaatcccagctccttgggaggctgaagcaggagaattgcttaaacccaggaggcagaggttgcagtgagccgagatcaggccactgcactccagcctgggcaacagttgaatgagactttgtttccaaaaaacccccaaaaaattcatggccataattctaggacttgcttttctaggactattacccaagggaataacaggaaagctagagggctaagaatacactatattaaatatggaaacacaaaggaaattgcaagaaaatcatgaatatctgttcaacaagatactagatcatcattcaaaatgatgtgtacaaattgttctacctaaaaagctgaaataacttgatttgtaaaacccttaattcctcctcattgtaaaagtccagaaaaatatataaagtaaaaaatatacagtaaatatatatgtctaaagtatttatatatttatatatgtaaagtatttatataaatatataaagtaaaatatatacagaaaaaatatataaagtaaaaaatcattataataccatttctgtcattatttggtatatagtttgattttcttttatatatacatctgctaatacacatatgaatatctgtttatatacaaaatctatatgcatatatttattttaagtgtgctcaaaactgtaccacacatgctgtattataaactttcttctttaatagtctgttgtggctaacttttcatatcaataagtgctggtctataatattttttaaaaaattatttcatggtaatccagtgctgagatgtaatgtaatttattttaatgagttcttattattggacatttgggtgatagctattattttgctattatatgctaacagttgtgtgaacatacacgcatgtatatatatgtgtctttatgtatgcatctttatttgtttttgaaattgccagtttcctgaaagggttattgctgagtcagggcccatgcacctttcaagacctgtgatctttataaccaaatttcagaaagtttagacatgagcatatatcagatgcttttcaactctggagagtctattttcagcaaagccatcagagttattctgttaagacataagtcagatagtcagtgtactcaaaaccctcccttttatctactacttcccatctcatctctctctaggaaaagccacagtccttactgccccattaagtgaccctctggatttatctcccattcaccttccaccctgcctgagcctcacaccagatgtcccctatgtcttctctcctttccgtctctggagagccctaccccagagctgaactgaattctctccagaatatcttcccccttctccaccaagcccctttcccagtttttctccacacaacttttcatgtcctaatgtacaacttatgcattcatttatgtagttaacttcttagtttttctccccctattcttcttccctccaccgacccaccagaatgtcacctccaccaggacagaggtttgcctattctgttcaccaatcaatccgcatggctagaagagtacctggcacatagtagatgctcaaaacatagttggggagtgaaaacatttgcctagtgttcattcgaggttttgtgttttcttttctttcttttcttttttctttcttttttttttttttttgctttgatgaattaactaattaactataatttgctgatttttctattgggtatttaacatttttaaattagacttaaggcccattaatacattagagataaaaactaatgttaggtatatatgaggaaatatgttttttccccaggttttgggggaaaagtttactaaacaatgcagaaaatattcagcatacttaagagaatactgatttggtgtatacacacacacacacagaggatcaacagtacatggtctgcaatctgctttttttcacttaaaataacattactgagatttacccaggctgttttcaatagatgtagcttatttcccttaactgctgtagtctatcctatgaatgtagctcacattgattagtcatatccctattactaaatacacaagttttttttctttttattttttcctttttctattacaaagaacaatccagtgaaagtttctctaagcatatattcctagaaatggtatcaaagggttgtggcgataggcacagtttgaattttatgacactgccaaaattgtcccataatacttgtccagtaatgtacaaatattcctaccttcattccagacttgaatttttgccaatccggcttgagagaggtgcattaaagtctaaccctttcagtagatttctgtgtctgttttcttgtatctccaacagttttcatatcacagattttaatttcaaaaatgtctacgaatcgattgtccccttcactaatgtggctcaatttaatactttttaccttggattattttttacttgaccaatattgcaagttcaaattttattttctacatgtatttgcctggtatatctttgcctcaccatttattttaaacgagtcagtgtgtcttacttctctttcctctggaaagatatttgtagattttatttaggatctaatctaaagatacttgttctttttacagatgaatttaaaaatccccattcatttttgaaagctgtttgtattccttttctcaagtcttcatcactctccctctctctgatggtatttcttttgttttctaccttttgttagatggagtgagttttctttcattcctacgtttataactggaaagtgacaaaacttgttaccactccgttagtggccatgctcatatctttgtacaaatgcttaaatatgtatttcttgaattttaatctcagaaactgaacactgcttattattgcttccctccataaatgatggagaaattagcatatcttcactccctccagtctttccaacttttttaattactagaatttatcataaactctgtcatagttttaaaaaataattatagcattcacattccattcagaaaatatttttatcacaattatttagattctgcagggcatgcagagaaagctggtgtcttggaaaattaaggctgaaaattttgtcttggaacagtggtttttttaaaaagtctatatttgctgaaattattttatcaaatctcagatgctccaaaattgggcacttcctatcttattttattattctatttgagacagggcctccctctgtcacccagactggagtgcagtggtacaaccattgttcaccatagccttgacctcctgggcttaagtaatcctcctgcctcagcctcctgaatagctgagactcacaggcacatgccaccatgcctggctaattttaaattttttgtagagatggggtctccccatattgcccaggttgatcttgaagtcccgggctccagcagttctcccgctctggcctcccacagtgctgggattcaggcgtgggccatcgctcctggccctgtgttaagttactcttatttctggtctttggagtttgcttgctcatttataagtgaggctgctacactggtgaagttcaaatagagactaatgctattaatcttgggtttcccatcacggctgttgaccagccactgcagcaatccttcaaggccactgcattgctctcctcccagtgtctcccctctaccctcgagcttgctccccagtgtctgagagagcctgtgctgctctataaactgaggtcacggacaaagctttctcctctggtgccacgctcatgcctaagaaaccttgctccaagatggggaaagcctttctgccctcccaggacccacttatttccagccctcatgcatcaatatggggaattcctactggggttggtcagaattccatccaatgctaatttctcgagaaagtctgacaccaccatgtcccttccatttggctaaattttattgattccagaaaaatgttaatttttcaaatgagtagtgtgtggtaccattctaatttccactctgtgctaataattccttttcctctggttttgctttctttttattctttgcaggaagagggagggaaaaattttggtaaacttctggaaagtatggtgtattagccaattgttacttgtaacatcaaccccaagactcaaatatattttgtaattatatttatgctgaatacacatatatttagaaccacagtgatttttggatttaaaaaaacacatactgcaattattcttattttcatgctaaagaaaaagataattatgttctttaaaaacagcattttcatggaatatgatgcagccataaaaaaggatgagttcatgtcctttgtagggacatggatgaagctggaaatcatcattctgagcaaactatcgcaaggtcagaaaaccaaacacagcatgttctcactcataggtgggaattgaacaatgagaacacttggacacagggaggggaacatcacacacggggggcctgtcgtggggtggggggctaggggaaggatagtattaggagaaatacctaatgtaaatgacgagttaatgggtgcagcaaaccaacatggcacatgtatacatatgaaacaaacctgcacgttgtgcacatgtaccctagaacttaaagtataataataaaaaaaagcagggttttcaaaataattcttcaaataaaggtattttaaatttactgttagtagagtactttaaaatctagcattaatttaaagatttagacattagcaatgcacttataagaatgaaaagttaaagaataatttggagaattttatttttaaaatttatgactcaacagcaactgaaacatttattaagtgcaagggaaattgaatcttaataaaaacaactagcaataatattataaaatttgtttttaattatttaattttctgatacatagtaataaagactgtgttgtcataaagtaagagtaagagttaactactatatgggatcatataccttgataaaagaagatttactaggataagaaaggtgtactatgaacgttgaatactggactataaaaatctttttttttttttgagagagagtcttgctctgtcacccaggctggagtgtcatagtggcatctcagctcactgttatctccacctccctggttcaagctattctccagcctcagcctcccgagtagctggaattacaggcatgcatagccaggcccagctaacttttgtgtttttagtagagatagggtttcaccatgttggccaggccggtcttgaacccctgagcacaagtgatccacccgccttggcctcccaaactgctgggattacaagcatgagccaccgtgcccggcctgtgcaaatctttaaataccctcctgggaggtggtgtccttaaggagaaagaattcctttaggacagttctggaataatggccaggaactattaataggaaaagaattagacctgtgaatttctgtttctcccaaaggaaagggaaatgtcattgaacgattctaccatgagcctacttacaattctgctctatcataaggcggttacatgtattatccagagccttaaattaacaatccaaggaagaagctactgtcctgtttatttaattgatggtaatgatgaaacccagagagctcaagtcctctctcggggccacatagtatgtcggcaagtcgggggttcttgggtctcagtgatcacaaaacagatacgacacacaaaacgtgaaggcagtggcaatgaaggagacaattccactctggctctcagtgctgaaaagggagaaatatgcttctgttctttgaagtgtccatttttcttggggtccattttttttcatttctgagaatatggcttctcctttaagaactgttattgtcattctaaaggtttactgattgaattcagctccctctgcattcatccctaaactacattacagattgtatgttacccttactctcactgcggaaattgctgatgaaacaaaatagagccatttaatttaccctttcgttttaaatataacaatgtcaccggtgtctgatgttccccttcctgtgtccatgtgctctcattgttcaattcccacctatgagtgagaacatgtggtgtttggttttttgtccttgcaacagtttgctgagaatgatggtttccagtttcatccatgtccctacaaaggacatgaactcatcattttttatggctgcatagtattccatggtgtgtatgtgccacattttcttaatccagtctatcgttgttggacatttgggttggttccaagtctttgctgttgtggggtggggggatgggggagggatagcattaggagataaacctactgctaaatgacgagttaatgggtgcagcacaccaacatggcacatgtatacatatgtaacaaacctgtacgttgtgcacatgtaccctaaaacttaaagtataataataataaaaattttttaaaaaaacaaaaaacaatgtcactataacaaatctgaaaggtgtggctgcttttctcacgttcatgcgttttggcaacttgtagttccttaaggtgtgacggatactctcttcttcccaaatgtactttcttcatctcctttaaacctcacattaaatcctcattatttgctgattccctgcctggaaattgcctacttactaaaatttgtttgtagccctcaaatcaataactcatggagctttcacggttattcatggccattcacagagtggcaaattctcaagtcacctaacagtcacatgaccagctgatgtcaaccaagacaatgctcggcctcctgttccagctctcatactgtaaacaaacatcctttttgtgggacatgtggtgccacattttttgcatttatgcttttggttgacaatcttgctatttaaaatggcccctgggcatggtggctcatgcctataatcccagcactttgggaggctgaggcgggtggatcacctgaggtcaggagttcaagaccagcctggccaacatggtgaaaccccgtctctactaaaaatacaaaaattagccaggcgtggtggcacacgtctataatcccagctactcgggaggctgaggcaggagaatcgctcgaacctgggaggcagaggttgtagtgagctgagatcacgccattgcactccagcctgggcgacaagagcaaaaactccatctcaaaaaaaaaaaaaaaaaaaaaaaaaaaggccccaagagtagtattgaagtgctgtctagtgtttctcaatcagggaaggctgtggcgtgccttacggaaaaattaacgtgttagataagcttcattcaggcatgagttatagtgctgttgcctgtgagctcagtatgaattaaaaatatacattaaataagatgtctttaaacagaaacacatatgcatgaagattgtgggttgatccattgacaaaaaaatgtgaccaggggcttgcaggaaacttatcctgtatttcccccaggatcaatgattcagtatcccctaattcagcgttcaaggtaactttataaaacattgctactctggataagaagaatcacacatgtgtttgtgtcttattccctctgctggagaacactgatgaatgtttttgtatactgcagggctacagtaaccaaaacagcatggtattggtacaaaaacaggcacatagagcaatggaacagaatagagagcccagaaatgagggaacattcctgcaaccatttgatcttccacaaagctgacaaaaacaagcaatggggaaaagattccctattcaataaatggtgcgggataactggctagccatatgcagaagattgaagctagatcccttctttacaccatatacaaaattcaacttaagatggattaaatacttaaatgtcaaacccaaaactataaactctggaagatgacctaggcaataccatcctggacacaggaacgggcaaagattttatgacaaagacaccaaaagcaactgcaacaaaagcgaaaattgacaaatagtatctaattaaacttaagagcttctgcacagcagaagaaattaccaacagagtaaagagacaacctatagaataggagaaaatatttgcaaactatgcatctgacaaaggtctactatccagcatctataaggaacttaaatttacaagagcaaaacaaacaactgcattaaaagtgggcaaaggacatgaacagacacttttccaaacaagacatgtatgtggccaacaatcacatgataaaaaggttcaatgtcactgatcattagagaaatgcaaatcaaaaccacaatgacataccatctcacaccattcagaatggctattactaaaaagtcaaaaaacaacagatgctggcgaggttgcagagaaaagagaacacttgcacactcttggtgggagtgtaaattgttcaaccattgtggaaagcagtatggcaacttctcaaagagctaaaaacagaactaccattggacccagcaatcccattactgggactatactgagaggaacagaaatcattctcccataaagacacatgccaatgttcactgtagcactattcacaatagcaaagacatggaatcagcctaaatacacatcaaggacagattggataaagaaaatgtggtgcagctacatcatgggatacgatgcagccatgagaaagaatgagatcatgtcttttgagggaacatggatggagctggaggccattatccttagtaaactcatgcaggaacagaaaaccaaatgccacatgttctcacttataagtgggagctaaatgatgagaactcatggacacgaagaggggagcaacagacactgggatctacttgagagtggagggtgggaggaggaagaggagcagaaaaacattaagtattgggtaccaggcttaatacctgggtaatgaaataatctgtacaccaaacccctgtgacacgagtttatctgtataacaaacctgcgcacatactcccaaacctaagataaaagttttaaaacaggacgttttctgtaacaataacacatacaaaactctcatattctatacctcctaacttcattctttcataggtaacattatttgctcttttgcttatcgtattatttttaaaccaatgcaatatctattttaaaaaatgtaataaagtaagaaataccatactttaactgttatgataattataattctgagccactgttccaagcaaaatggttaaaatatttccatgtaaatgttcatgtaatactttcatgtaaatctcccataatactaggtcaagggttcttaatttctctgtctcttatttaaacatatcaaccaaagtgacaggttctgagagtttgcacctttttaaagtaccacaataatccatccagtggaacatgacacccaatggataagcccagaggagccgtgtgactttcaaaggaaagttctgtcattcaaatctgtgctcattgaatctggactaaaagaatcatggttgaattattcgttgaatattttggtaaatgagacactaaaataactgtatccaaccctgtggcatcttgcttaataaaataactgtctataaaaatgtaaaccccaaatgatcttcaaacacatatttcattgaatatctgaacctgtttccacttgattccttcccattcccactcctcaccgctctctccctttctctttctttttcttctttctcaaataaaaagagagagacataagcagagtgttaaaaataaaggatgatctaaccaatacgagactgagagtcccaaactgctgctaaattactcaggacattagagtcagactatgcctagaatagaaaaagggcaattttcaatctttttctccccaaaaggcccagcaacatggggaagaaaatagtgatcatttgcttaattgtctgatcctctgatcactaatatggaaagacacattcacagatattctagaacatgccatgtggtataatagaaggaacaatggcccatgagtttgaagaccttgggttctggccttcctgttaactatgatattggatgagtctctagaccatcctgatttgctcacctgtgtaatgagaataaagatacttggtgtgtctattccataggactgaggtaagaattcttggagatgatgtgttggagagttctgtgttaactacagacggaaagtaatgtatggaattactagatatattgtactttcaggtcactgcataagtttctactcaaaagaaaattatagcaagttcttttataaatgaaatatccttttgaagatcattttgagtatataggttttttttttttttttttttgagatggagtcttgctcttttgcccaggccggagtgcagtggcgcgatcttggctcactgcaagctctgcctcctgggttcacgccattctcctgcctcagcctcccgagtagctgggactgcaggcccctgccaccacgcccggctcattttttgtatttttagtagagatggggtttcaccgtgttagccaggatggtctcaatctcctgacttcgtgatctgcccgcctcggcctcccaaagtcctgggattacaggcgtgagagtatatagttttatatagagttcttttttaagtgagataccacagggttggacctagagttatcttagtgtctcatttgacaagtgtctcttccttgtagaactgcaatgaatttgcactgccaagatttgtaaacaatatcgattaattacatgtgtctgttgcatcttgaatatactgccaatgatttttaaatatttttttaaattatctcaaaatatatttcaatttaaaacatgtaactagttttattaagtgtttaatggatacctcagtgtcattaaactatatttttaattttctatttaattattaattctttctgttccctcattccttttatttgtgttatcacttatcttgctacccaaacgttgcatacaattaatcagctgatcactattttctatcagtagcttccccatgttgctgggccacttggggatacaaaagattgaaaactactctttttctattcacatatttattcaacaaacatgcactgggtgcctactatattggtgatgggattgggagtatagacaaagcttctatcctcaatgaggttacattatagagaaatactaagcaaaaaatgtcttggacagggcagaaaagacagcactgcagttgcacccgcacaggtgatgtccctcaagaacgcagttcctggagctgggaccacgttaattcttctgtctacctgcagagggcgccattgcaccaggtacgctttcagtctcacctggtaaaactagaagatggcagctttacaaagaatttcaagaatcctaaaacagtaaaggggtcttatgtgggctaattgcatgaggtgctgaacttaagtatcttcagttgctggagaaaagcagaaattctgcgtttaaggggagaaaatggaggaaaagtgagacaggtgtgtgtggatactggatgtattcatttgtttcaccttgtgcccggcttttcctaaggcctggagacccggcgatgaacgcagttggctatcattgctctcagagggcttactttgtactggtctgtggtgtgacaatgtagaataatgtgaataaagtaataacaatgtccaaaatttattgaatgctttccatgagccaagaactattcaagaatttcacatacattatcttgtttaaactgcacagccgcgcgttgagaagaggtgctatcaactttcccattttgctgatgaggcaatttaggctggatgagaggacgagactgagtactactttcttggtggaggcgacagtcaaagccaggcattagaccggaatcgactcagttaaccactaggctgtgtgtgacagctggaggttagggaacgcggaggcagagagagggaagcagcgggtgcaaagggcagagctacttcggattttatgacggtcaaaggcctcaatgaagaaagaggtaacatttgtttttgttttgtttttgagacggagtcccactctattgcccaggctgtagtgcagtggtgcgatcgcggctcactgcaacctccacctcccgggttcaagcgattctccttgcctcagcgtcccaagcagctgggactacaggcgcccgccaccacgcccgggtaatttttgtatttttggtagagatggggtttcaccacgtcggccaggctggtcttgaactcctgacctcaggtgatctgcccgccttggcctcccaaagtgctgggattacagacgtgagccactgcacctggcgagaggtaacttttgaattgaaatctaaattgtaagagggaatcaactccaggaatatctagaggcagagagcaccatcggtacagcaagggggactgccctgagcagaaaataagcagggaacgtttcagaaaaagtccaggaatgggacaccagcagcagggtggctagagctggagggaagggagaggttatgtcagggctgagccgggagcctacggagccctggctaggggctcaggttcgctatcgcaatggaaactcctgggagctgtgagagcagtgatatgatgggatttacacgtaattatttctccgcttctaggaggcgactggatggtaaaagcaagagcaggtagcagacttttaaataacaataataatcgtggtaatgatacaataggaaaacaacacagcattggtgttatcttgatcggtgaaatacattagttttttgttgttgttccaaatcagcccacttggttctgttacttatctaactagagatcagtctgatatgacgcatggtgattttgaaataccagcacagaacatccctgagatgacggtgatctgaaaagagccctggccctgttcttgtagtgtcccctcctccatcgcatgcgcacactagaggctgatggtggttcgcggatgctaccaagaaggtacaaaaagctgattttacagggatttgtctgacccgtgtacaattatctctcagagtttccaccttttgtttcttcactcctcctatttgccaaaacagtcactggtttgcagagacttccctccccacactctgccctcccgtactcagtcctgcaaaacggagcttgtgtcaaatgaaacaatctccgtttcctggtggacatacttccttgatctctggggcttctgcccttcttttttttttgagacggagtctcgctctgtcaccaggctggagggcagtggcgcaatctcggctcactgcaacctctgccttctgggttcaagtgattctcctgcctcagcctcctgagtagctgggcctacaggcgtgcgccaccacacccagctaatttttgtgtttttagtagagatggggtttcactatgttggcccaaatggtctcgatctcttgaccttgtgatccgcccaccttggcctcctaaagtgctgggattacaggggtgagccaccatacccagccttgcctcctttttagaagaagattatgataatactaacaatagcttgaagataataatgagaataatgaaaataagtattgcttaaagttaaaaataatgaaaataaataatgcttgaagagaatgataatgaaaatagtaacagcaacaataataataatagttaacatttcactagcatttgccatgtgccaggcactgtgattgtgctttatagattaattatttctccaaacaaccctgtgcagtgggtgtattattgttacttctatttttcagaaaaggaaactgaggcacagagagtttacaggatttgttcttgttgcacagctaataaatggctgcattggaatttgaacccagttgtctgggaagagccattctaatttggagaaatatttagtacaatctctgatcaaggacaaatcctaaaatgtagcttggagagcagtttaatatccaatggcaagaaccgccattcattttgcaccaacctaatgcatactcctgctgaaaaaaagaggcctacgatattcttgagagtgcaaggaaaggatagtgacatcacctgatcaatgcagaaagaaaggattatagtgagacaaaactttgcaagactcttaagaaacagtggctttaacttcatcaaatttgctacctgctcttagttgagtaacaagtaagtcatctgtcctctctgagccagattcctgaaaaacaggtaatttaattatttttttccagcatcactgggggggtggttatgaaaattgaaggaaattatcaatgtaaaagctttctgaaagcttgtaacatattatgcaaatgtaagattaactatatctgcaatgcaactgattatcagttctttagtgaagtgtaatgataattctaagtgttacttcagattcaaatgaacatataattttagaaataaactagaatttggcctcacgaccttggccataactttcttttttataataaccaaccatatatttatattcagaatctctctataatgcatctatttcttcaagctatatttaaaatatattaagtaagaaattaaaatgaagtcatttttttcaaacgtacaatgtaattttatattaaattttaaagctaaatgcattcattcagtgattaatttgtttaatgtgccaggcaatattccaggcactaagatagagatatataattcagaccaacattcttagtctcctaattccttgtgttaaatggaggaaacaaataagtaggtaaacaataattaattttaatattttgctatacatttcacaggtaagtggataacccccatgactttgcaattcaaatttagtgtgtcagacacttccatatatgttatctcctgtgaagttcagggtagctgtgtgagttaaaagaaccacacatttaatttgttgctttcttattagatggctcagaatggaaaagggttggcgaaagttttcagagctagaagtgacagagccagggctggaatagaggctttagggcaagaagttctgagaagaccccagagactctgagaggacgggaggatcttatcatcactgagcaagatactgccccaggggtggtagtttatggtttttattcctcacactgcttccttatttagtgagcatgtaagttaattaaatcagagtatgtataatgcatcatataactctatgctaatggttcccttagtatatcttatgtttctcttatgtactttgcttgcattctcttctgaggcccctagtaatgacgtgtccttttagaatatgaaattaaaaccaagtattctaaattgctttcatcatctggaaattttgatgtatttttgacatcttacaattatgtcccttaaaatttctctagaggttctagaacaagggctatttttttgtatgctcacttgactgcaatttcaagctatggaaataagtgatcaatattctcccaagccaaaagccccgtaggacaaccataaagctcctcagtgaaattcagaaatggtcatctaaaacgttgcttttcacagccctacatttttctttcttactgctgttaagttgagcctaaagctgtcttcttacatattttaagttgggcctaggggtttctccatacataataaactggaacctaactgtatgtgtaaacaacctactcttgtaccaatcactgagttttggtcaacaaaaggcagctcactgttgaaactgtgtcaaataaggaaaatgtcaagctgaaccaatctggctgtttcttttcctcacttctattttccatgagccgtgttctgttttctgtccataaatctttttcaaccacagtctctctgaacctattctgatttggggctgcctgatttggaaatcattctttgctcaattaaactctgttgaactatttctctaagatttttcttttaactatcaatctgagtatagatacttagtgtctttagagctaaatgtgttgcaactagatcacataataaatttcaagaatcaagaacacttatttattcattcactcaatacatctttttgaatatctagttaagtgataaatactgtcctaggaactaggaacgctaagataaataagatgtagttcttgaactcccaagaggatcaatccagtgaaatagacagctgactgacccagtcctcatgaccaccatctactgtggggccagtgaaaatcgaagaaggctttcctaaactggcaatacggttgttgagtcttaaaggacctagagtgttaacatagccataaactttctacgtgactcagtttttctttgattaacttatccattgcattattaagataaatccattaataatgaatagttgcagtaaagacatctttaagaaaacgattttgcttttaagtaaagcagcaggtgagtttttatatgtaagagctcgtcaggagttaattttctttctcttccctgattcatttagcttatgttaaaccaggcatatttctcccatagtatttaaaaacaaatatttaaccacatttctctgaaaattatttaggaataggtcttaatatccttctatttgaaatgagagccttcccttattagaaaaatcttcatgatgcttagaaagactgcattaaaaaaaaacaaaactccaaaacttgagaatatatagtcctttaaatctgcagttccactgaacaacctaaaaagttctgtgaatacccacagaggaaaaggaaacccagttctattttgcaacttccattgcaatttcttccttgaaatttttaattattttgagtgagattaaaagttactaagcatatgagattgaagagtttttcataactgatatattattgttatgtgtcattttaattccactttgacttgaacttcaaaattaatcattgtaaaacaatcagtgcttatttgggcattgatcaatttcttttatccaaactgcttctcgaatctcattccttttttcttggtttaatttcctgcttatagaaggctatttttagtagatctcttagtgatggtctgtgaatggaaaactctttcaatattggttgtcaaatttaaataatatcatatctggctatacaaatataggttacctgatattttctctcagtgccttgaaactattcttcatttctgaccttcatgagtgcttatacaattttggagataggctacgtatttattcttttgctgctttaaaatcctcctttataaaagtaaagtctctttttccttgagtttcttcaagtttggggaggtgcatctattggcagactttacattttcaccaactgtaactagcgctcagtgtctttcaaaatttgaggatttatgtccttgttcagttctaaaaactacctcaactatgatttcagtaaatactgcttgtttcttgtgctctcctactgaaacccctctcatgtgttctcttctgggtctaacatcctttactctatgtgttttaacctctcttccatattttccatctccttatgcaactgtgcagcattctagatctttcttccaatttacttgtgcactgaggttttaattataacgaccatatttatttgtataatatttgtattattacaaagcctctttggttgtttatcaaatcttcctggaatttttcctgatttttttttctaatattatctagctctcatatcattttttgcgggtaattttatataattttaatggtctaaaaatattatttagattattctaatataaatttcttgtcaatctgtttacttttctttatgatacagtgttttcttgggtggtttctcattttcgttgctagctcaccttcagaagaataggttttcttatgggaattccatgtgcaatggactaggaaacaatattctatagcaattttagctttactttttccaggtgatatagtttggatatttgtccccacccaaatttcatgttgaattgtaatccccaatgccagtgatggggcctggtgggaggtgtttggaccatgaggatggaacagtccgtcatggcttggggctgtcccatgatagtgagttctcgtgagatctggtcatctaaaagtgtgtggcccttccccctcactctctccctcttgctcctgcactatgtgacatgcttgttctcttttcaccttccaccatgattgaaagctccctgaggcttcaccagaagccaagaagatgccagcacgatgcttcctgaacagcctgcagaaccatgagccaattaaacctcttttttctttctttttctttctttctttctttcttttttctttctttttagttatactttaagttctagggtacaggtgcacaatgtgcaggtttgttacatacatatacatgtgccatgttggtgtgctgcacccattaacgtgtcatttacattaggtatatctcctaatgctatccctcccccctcctccaccccatgacaggccccggtgtgtgatgttccccatcctgtgtccatgtgttctcattgttcaattcccacctatgagtgagaacatgcggtgcttggttttctgtccttgccatagtttgctcagaatgatggttaccagcttcatccatgtccctacaaaggacatgaactcatccttttttatggctgcatagtattccatggtgtatatgtgccacattttcttaatccagtctatcattgatggacatttggcttggttccaagtctttgctattgtgaatagtgccgcaataaacgtacatgtgcatgtgtctttatagcagcatgatttataatcctttaggtatatacccagtaatgggattgctgggtcaaatggtatttctagttctagatccttgaggaatcactgcgctgtcttccacaatggttgacctagtttacagtcccaccaacagtgtaaaagtgtttctatttctccacatcctctccagcaactgttgtttcctgacttcttaatgatcgccattctaactggtatgagatggtatgtcattatggttttgatttgcatttctctgatggccagtgatgatgagattttttcatgtgtcttttggctgcataaatgtcttcttttgagaagtgtctgttcatatcctttgcccactttttgatggggttgattttttcttgtaagtttgtttaagttcttcatagattctggatattagccctttgtcagatgggtagattgtaaacattttctcccattctgtaggttgcctgttcactctgatggtagtttcttttgctgtgcagaagctctttagtttaattagatcccatttgtcaattttgtcttttgttgccattgcttttggtgttttagacatgaagtcctcgcccacgcctatgtcctgaatggtattgcccaggattacttttagggtttgtatggttttaggtctaacatttaagtctttaatccatcttgaaataatttttgtataaggtgtaaggaagggatccagtttcagctttctacctatggctagccagttttcccagcaccatttattaaatagggaatcctttccccatttcttgtttttgtcaggtttgtcaaagatcagatggttgtagatgtgtggtattatttctgagggctccgttctgttccactggtctatatctctgttttggtaccagtaccatgcggtttggttactgcagccttgtagtatagtttgaagtcaggttagcgtgatgcctccagctttgttcttttggcttaggattgttttggcaatgtgggctcttttttggttccatatgaactttaaagtagttttttccagttctgtgaagaaagtcattggcagcttgatggggatagcattgcatctataaattaccttgggcactatggccattttcatgatattgattcttcctatccatgagcatggaatgttattccatttgtttgtgtcttcttttatttcgttgagcagtggtttgtagttctccttgaagaggtccttcacatcccttgtaagttggactcctaggtattttattctctttgaagcaattgtgaatgggagttcactcatgatttggctgtttgtctgttattggtgtacaggaatgcttgtgatttttgtacattgattttatatcctgagactttgctcaatttgcttatcagcttaaggagattttgtgctgagatgatggggttttctaaataatacaatcatgtcatctgcaaatagggacaatttgacttcctcttttcctaattgaatatcctttatttctttctcctgcctgagtgccctagccagaacttccaacactatgttgaataggaatggtgagagagggcatccctgtcttgtgccagttttcaaagggaatgcttccagtttttgcccattcagtatgatattggctgtgggtctgtcataaatagctcttattattttgagatacatcccatcaatacctagtttattgagaatttttagcatgaagtgccgctgaattttgtcaaaggccttttctgcatctattgagataatcatgtggtttttgtctttgtttctgtttatatgatggattacttttattgatttgcttatgttgaaccagccttgcatcccagggataaagccaacttgaccatggtggataagctttttgatgtgctgctggattcggtttgcccgtattttattgaggatttttgcatcaatgttcatcagggatattggtctaaaattctctttttttgttgagtttctgccaggctttggtatcaggatgacgctggcctcataaaatgagttagggaggattccttctttttctattgattggaatagtttcacaaggaatggtaccagctcctctttttacctgtggtagaatttggctgtgaatccgtctggtaccggacgtttttcggttggtaggctattaattattgcctcaatttcaaagcctgttattggtctattcagggattccacttcttcctggtttagccttgggagtgtgtatgtgtccagaaatttatccatttcttctagattttctagtttatttgcgtagaggtgtttatagtattctctgatggtagtttgtatttctgtgggattggtggtgatataccctttatcattttttattgcatctatttgattcttctctctcttcttcttgattagtcttgctagtggtctgtcaattttgttgatcttttcaaaaaaccagctcctggattcattgattttttgaagggttttttgtgtctctatttccttcagttctgctcggatcttagttatttcttgccttctgcaagcttttgaatgtgtttgctcttgcttctctagttcttttaattgtgatgttacggtgtcaattttacatctttcctgctttctcttgtggtcatttagtggtataaatttccctctacacactgctttaaatgtgtcccagagattctggtatgttgtgtctttgttctcattggtttcaaagaacatctttatttctgccttcattttgttatgtacccagtagtcattcaggagcaggttgttcagtttccatgtagttgagcgcttttgagtgagtttcttaatcctgacttctagtttgattgcactgtggtctgagagacagtttgttataatttctgttcttttacatttgctgaggagtgctttacttccaactatgtggtcaattttggaataagtgtgatgtggtcctgagaagaatgtatattctgttgatttggggtggagaattccgtagatgtctattaggtctgcttggtgcagagctgagttcaattcctggatatccttgttaactttctgtctcgttgatctgtctaatgttgacagtgggatgttaaaatctcccattattactgtgtgggagtctaagtctctttgtaggtctctaaggacttgctttatgaatctgggtgctcctgtattgggtgcatatatatttaggatagttagctcttcttattgaattgatccctttaccattatgtaatggccttctttgtctcttctgatctttgttagtttaaaatctgttttaccagagactaggattgcaatccttgcttttttttgttttccatttgcttggtagatcttcctccatccctttattttgagcctatgtgttgtctctgtacatgagacgggtctcctgaatacagcacactgatgggtcttgactctttatccaatttgccagcctgtgtcttttaattgaagcatttagcccatttacatttaaggttaatattgttatgtgtgaatttgatcctgtcattatgatgttcgatggttattttgctcattagttgatgtggtttcttcctagcatcgatggtctttacaatttggcatgttttagcaatggctggtaccagttgttcctttccatgtttagtgcttccttcaggagctcttataaggcaggcctggtggtgacaaaatctctcagcaattgcttgtccgtaaaggattttatttctccttcacttaggaagcttagtttggctgcatatgaaattctgggttgaaaattcttttctttaagaatgttgaatgttggcccctactctcttctggcttgtagagtttctgctgagagatcagctgttagtctgatgggcttccctttgtgggtaacctgacctttctctctggctgcccttaacatttttttccttcatttcaactttggtgaatctgacaattatgtgtcttagagttgctcttctcgaggtgtatctttgtggcgttctctgtatttcctgaatttgaatgttggcctgccttgctaggtaggtgaagttctcctggaaaatatcctgaagagtgttttccaacttggttccattctccctgtcaatttcagatacaccaatcagatgaagatttggtcttttcacatagttccatatttcttgaggctttgttcatttctttatactcttttttctctaaacttctcttctcgctccatttcattcatttgatcttcaatcactgataccctttcttccacttgatcgaatcggctattgaagcttgtgtatgtgtcacgtagttctcatgccacggttttcagctacatcaggtcatttaaggtcttctctacgctgtttattctagttagccattcgtctaatcttttttcaaggtttttagcttctttgaaatgggtttgaacatcctcctttagctcagagaagtttgttattaccgatcgtctgaagccttcttctcccaactcctcaaagtcattctccatccagctttgttccgttgctggcgaggagctgcattcctttggaggagaagaggcactctgatttttagaattttcagcttttctgctctggttactccccatctttgtggttttatctacctttggtctttgatgatggtgacgtacagatggggttttggtgtggatgtcctttctgtttgttagttttccctctaacggtcaggaccctcagctgcaggtttgttggagtttgctggaggtccactccagaccctgtttgcctgggtatcaccagctgaggctacacaacaacaaatatttcagaacagcaaatgttgctgtctgatccttcctctggaagcttcatctcagaggggcacccagtcatatgaggtgtcagttgacccctactgggatgtgcctcccagttaggctactcgggggtcagggacccacttgaggaggcggtctgtccattctcagatctccaactctgtgctgggagaagcactactctcttcaaagctgtcagacaggggcgtttaagtctgcagaagtttctgctgccttttgttcagctatgccctgccaccagaggtggagtctacagaggcaggcaggccttcttgagctgcggtgggctccacccagttcgagcttcctggccgatttgtttacctactcaagcctcagcagtggcagacacccctcccccagcctcgctgctgccttgcagttcgatctcagactgctgtgctagcagtgagcgaggctccgtgggtgtgggaccctccgagccaggcatgggatataatctcctggtgtgccgtttgctaagaccattggaaaagtgcagtattagggtgggagtgtcccgattttccaggtactgtctatcacagcttcccttggctaggaaagggaattccccgaccccttgtgcttcccaggtgaggcgatgccccaccctgcttcagctcatggtccgtgggctgctcccactgtctgacaagccccagtgagatgaacctggtacctcagttggaaatgcagaaatcacccgtcttctgcgtcgctcatgctgggagctgtagactggagctgttcctattcagccatcttggaacaagaaccaaaactcttttctttataaattacccagtctcaggtatttacagcaatgcaagaataacctaccacaccacgtattccaagggctcgaaagcctgaacccagtttttatgtttatttattggcttggtgattcctgacatcatacttacgcatagcacaggcttggggttttacttcttctaagatactaacttgtttctctttccacttccttattgcttccctgggttggttggcatagttataatggcttgacgttgaggtcctgtctttcttctggggtctcagtcactactcctcactacgtatggtctccaagtcatgttcactgtcactttgggagcattactcctcattcccactcctagtggaatattaaatccagtattctcccagacctctgcaggctttcaaacttatcactcttcatttaaattcattcttcgtttctcacatctagttatatattttctctgatacacctagtaatgtattgttacatttttagctaccatttctttgtgtctaaagaaatagggcatttgttttagttctgacaaccctttatgttaagggtcaatagagccatcgaaatgtttttctctccagattttattcatcagaaaggctgctttcctttaggaagttgtcccacaaaatggtttccataaattcaatcaattggtaagacagaaggtctcagttgaaaactatttcaaatgcaaactactaaaaccatcagggaggtaaaaatctaatgtttcttgtcaactatatagaaaaatatgtttttgtaaacaattggttgagtttaaactacaaaaaactacaaataagaagcattacaactatttagacatatctctacttactatagaacctttgctgtgaagagctaatctcatggtaatattttgccaagatgatgaaataaaatgttaacttaaaataaatatattttatttggctaccattgttatttctctttttttctggagtacactatcattacatttctttgcacctttaacagggaaattttaggacatgattatatgcatgagccctgggtcacattttaagccacaaaaccagaaagacaagatgtttctaatgtttgatgctgtcccttctattcaactgccatatatgctcatatattttaattttttaaaaatagagacaaacttccactatgttgcccaggctggtctttaagtcagacaaatgcaattacttgattccaagatggtagattactggtttgtttacaatagagagaaactaggaaacaaaactaaatatttaaacaactatgggacatctaaatgacagaacgttatgcaactattaaaacaatgtttttgtagagaattaaatgatattagtaacttatcataacataatatcaagcaaataataggacatacaattgtattttgaagaatatgtatatgtgtttaaaagtagcaaaatgcaacatagtataattttagaaatgctaataattcctaggtcattttaggttgccttgtgttatcttgtattttctttccatactttgaaagttttctacagggaataaaaattacttttataataaaaatccaagaaaaacatattggtgttctgatagcaaagtttaaataatcatgaaggcagagttcagacttttcaagaccatgctgcacagaattatgagtgacaacaacatgggttatgccacaaagaatcagctgtcaaaaagaagaggaaacaaatatatcaaagtaggccagaaaatttgctcatcagtgctgtctgctagaactttctgtgataacagaaatgtggtatgtctgtgctgtccaatatgatagccattagccacatgtggctacagagcacttgaaatgtgactaggagatgaaggaacagaatttttaatttaatttaagtgatatttaaattttttaatttaaatagtcatatgtaattaatggcttccatgttggacagcacaaatctccttcgtcacttaagggttattgcctattcattagtgggaagaataatatatttatatcaatgatatgttaattatatattaaaaataaataattatagataattatagttggcagaactggcctagttattttccccacaacaatgctgatcttcctatgatgagtccaagattttgcaacatttggcttttgctatggtttggatatctgacccctccaagcctcatgttgaaatctgatccccatgatggtggtggggcctaatgggaggtgtttgggtcatgggtacagatccctcacgaatggcttggtgccatcctagtggtaatgagtgaattctctttttagcaaccataagagctggttgttaaaaagagccttgcactttcccacctcacttgtgcttcctctcttgcaatgtgatctctgcacgtcagctctccttcaccttctcccatgagaggaagcagcctgagggcctcaccagaagcaggtgctggtgccatgcttcttgtacagtctgcagaactgtgagccaaataaacctcttttgtttataaattacccagagtccgctattccttcctagcaacactaaatgaactaagatagcttttaattacaacggtggcatctgttactactctgcattctcatcttcattccaggtaagtaaattttaagttttggcttctcttagttccaagacacaacataagtcattccctgtttttgggaggagagagtcaggatggagaaaagaataaaatttattgaaaatttaaaattaagataattaactatgtgaactaaaagtgagtaatataataccttctcccagaaaagatcaggacgggagtgttacaaagctttgacatttcttaaagtgcactctgctgcattttgtgtgtggtctatgtgtaatagctcatcttcaacacacacatacaaacacacactcaagtgtgagaataaaattaacttattttcttatgtaattttggagtaagtttatttagagtcatatgttttgtatttttattgaaatatatgcttgttacctgcagttttgtaaaaggatagcatttattctctctctcttccttcctctgtctctctcaaattgcccagagggattaatcaacagaaatctaaattttagaaaacctgctttaaaagagtacttgttctctattttgagtttatgggacaaatgaaactgttctttcaatgggtgttggcaaagaaggtctggaaaagtttatatgaattgccaagcatggaatattgatcattagccaatcaagctggatgatactggacattatacttagtccacagaagaataatataggtatatggatataaacatatttttaaaatgttgaataagggacagttcagatctttttcaatttcagttcataatgcatggtattttcaatgctccatgcatggctaaatacacaaacatcataaatgattctaaagcatgatagggtgcttgcccttaaaaattaccagtagctaacacttttgccagttcagggtacaaaaaaaataaagaccaggagatgctaaaatgatccatatcactatggttataaactttgaaacttacaatgcacaccttaaaatcaaagtttccaaggaaaccaatgaatatattttaagacaagaataatatgatttgcaaatcaaaatccatttaagactgttgccacagcactatgtgttgattggtgcttgccatatttttttaggaagtcagaaaaaaaaatcttatgttccatgaatccagcaataactaagactgcaaccctgattttcttacccgtctgccttgttaacatgatatatgtcaaacataatgaagaatatgtaaaagaacccttgttaccaacaaagattttgcaatatcttcaatacagagaatagaagaaccagaaagaagcagcgacaggtaggcggagagaggaagggaggaaactactgactgagtaaccatgtatgattgggaataaaatgggatctcaaaatcagattccattttgcacccaaccacaactgagaaaactgaggctcaaaaaagtgaagtcattgacacaaggtgttgactattaattgctgagtcaggatatgaagcccagttagtctgattccaaaacttatattcttcctggtggatcagacagaaggaatgggaaaatgcaatgcactcagggtgctcagtggaagcgttggagtgtggagttcaagtcctgagcgaatgtattcctggataaagaattagtcatcaggggaaggtcatgctggagctacgctgaagggtaaagtttgtttttggactctacctgtttcctctccttggctctaagatgacatgcaccagggatctcacctctaatcccgccattgcatgaagagaatgccttgcacatgactagatgctcaacaagtatttgtaaatgtgcatcttaaaaattggtcatgtcagttacgatgtgaaattcaccagtgaaaatgctagctggggctttgaacctggagctactaatttcccaggttccatctcataccatctgcccggcatagtcctaccacccatattgccacactggttttagcagggcaatcctctgaaagtatttttgctacagtggcttgaggcatagtaatactagatggagactaggaactctaagcaaatatctataaagttcacaacaaggctgtgttgatcactctggaaagaggtggtgaaacgattctctttgatgactcctcctgtgtctgcgtatctgtgctttggatagcccacacaggtacatcattaaatgccctcccagggtactgcaccagcctttgagcaggatttaaccttcagagtgcactcagcaattgcaaagtagtgtgctggtgactccattcccagacgtccctcttgacacactgaactctagagtgtttcatctcgtggtatgaaccaagaattggaacagtcacttgggcagagggattctaggtcctccgtataacctaagcaaagacatttttcttttccaagctagaaaaacatgcctaaaacagaaataagtataagcagtctttgcaagccttaccatttctacctccctctggggaatccaacctgtggtatagcactggacctggacaaatagcacagtgatctactaggagtacaatgtgttatcactgttgcttttattataacagctggcagctggccaaagctttgcaaagaaaccagaaagcaacagcagggcactgggctgccttagaaaaacatttcttggctcaaagaggagcctctttaacaagaacccaacacctcaaacctagcaaaaaagcatagctcaggtcaatcacataaaacacagcttcacaaaatctgtcccataacaaagctagaaatacaatggtgtaataaatttggtatacctaagagcctgagaaaaggtacagctgcttaagaataagttatagaaaatctttgttaaatactctagggaaggattcaggcatcttcctacttatctaactttttagtgtattctaaacttggccaggaaggagaggtgtgatcttggcttggtgattcctgtagatctccggactttggctgcctcacctttacctgaaactgttgaatgggatgctagattccctccagctctgacattccatgactaaagaaagtcaaggtttaacactgaccttgacatcctggggcaatggagagttttagtgtatgcaattgtcatgcctgaaaaaatgtcaaaacatggttagggttcctctccttgttcaggagaataaaatagtatattttaaatatgctagtataaatcttataaataaaatagtataaatctcccttctgttaagagaatgtagaaataaaataaataaaatactaaatactaaatagtattagtatagtaaatagaaataaaataaataaaatactaaatcgtagaaataaaatactaaatactaaaataataaaatactaaagtttgctcaaggaaaagatgaagttagatatgtgtttccttttaaggaggttttcatgaaagaattttttttggcagatcacttgagcttaaaaggagtattgttgtttcagaaatagcacaaaaagctgttccccaacaagggatgcagcagaggcagaatgtttaccacctagggtgttagtgaaaggccctgtctctaaacatcccacgttgagataacttcaatgtttgatcaaaaagtaaatcttatcccgtaataagtgagcaacgttctgtttcccctcacccctcaatattgaagcaatgacaagataagtcctctcctgtagacacatttaccaaccaagtgaaacatggcgtcttgtcggccttaaccgctagacttgagagaatggaattttcatgaaataagagtgccgatccataaaatacatgccattcgttttgatttaaattataaacaatcttatccatggtcttcttttatttttattttttaattttcccttccattctttgatttttaaggagtctccttacaaagtcagaacagtttttgtttttaccatagccaccatggttaactttttctttagaaaaatgttcagtgatatccaagggcagaaaaccaaacaccacatgttctcactcgtaggtgggaactgaacaatgagaacacctggacacagggcgaggaacatcacacaccggggcctgtcgtggggtggggggaggggggagggatagcattaggagagatacctaatgtaaacgacgagttaatgggtgcagtgaaccaacatggcacatgtatacatatgtaacaaacctgcacattgtgcacaagtaccttagaacttaaagcataataaaaattaaattaaattaaaaaaagaaaaattttcaatgaaacaaatgcacttcctgaagttactaagcctacacaaatgaatgaatgaacgaatgtctttcctgtagttcttaagcccacatgaacaaatgaatgaatgaatcaatcaatcaacgtctttcctatagttgttaagcctacatttacgtaaaggggagttgctcttacactgacactgtcaaaaccctctacctcccttccactccctccctgccaggtaaaagctccacctaagatagaaggcaacccaggttccaaagtaattcctccctcacctgtgaatgaccagaattattatcctctaagtgcttctattgtcacttgaaaaaggtacctgcttacctgattcaattaattcacaagaaaactaggaggaccgcttggtttacccaaggaattgggactaggaaagtttgttaatgtgaacaagccacctaaatctgtgattctcaaagaaagacctgaattccattgctctgaggactagaaaacagcccagggctgcaagtgtttccttcaggttgcagggaaacaacatgcaaaaaggttatgctaacatttggaacgcacgaactaaatttgcttgttaataaaatttcctgagacctctaattcggactttcctagaaagtctgcctgtcacatcatacgcagcagaatcacaaagttgtgaatgcacacgtccttggataattgggattccagtaattttccattccaagaggatgttttattactgctcctcagtgttctgagttggtcatgattttcagagactgatgtttatgaatttaagttgaaaatttatgtttatgttatcctcatcaatttagtttgttataagttgtttggtgaatcccatacagtgcaatgaagcatatttgcatcaatgacatttctagactataaacttccaattatttcaccaataaaatatgtatactttacagtacaaatgcgagttatccataccccatcttctgaaacaaatatgtctgttttccttgtatattcccacccctagtctacaattttgcctatatagtgtcactttattattatcgctaagttatttttctacctataacttacctagagtaagataacacagccatggaatcttttaccctacctaaatgtgtcataacaagatgtctttgaaactcagctctaaatgctagcatggatggaaaactatggttccatttgcaaggctggcttacagagcacaaggagatacagttatgaaagggctggactacgacagaagtagtaggccaatagatctatatagtcagctttttgtcatgtaatttattaactatgacacaaatgcatttaagaatatcaagtatttctctggctcttgacacagttgacttaaccttttgctgtctaaggaactgaggctttcctgttctgggtgctactggcaaatgttctagtacttgaagtcgggatgcacagcttcaaccactgacttatcagtgcagccacctgtgtattgcaactggccattaaattaaacaccgagccacctgggtttagttcggtcacttccataagtgtatttagcattggtagccctgctttattaaagtgcagcagacgtgctcttctgtcccttctgtcccttctgtttgtggttctttgggaaagttctgatatttgcttttgttttgtgcttgctttcgtgtttttatatcttgtatttatccctgaacatatttcgaacatttttttaaggaaagaaattcttttgtgtatatatagatacttgcatgatatactgtcatcaagtttcggttcctcaaaaggtcttggagctgtcaggtgtgatgtactccaaccatcaaagttctgtggaacacggtttgtatgtaaataaatgtggggcgtttggcccttgaaaccggaagacattacggtaggtgaaataagccagaaacagaaagttaaataacgcatgtgctcattcatatgtggaagctaaaaaatagttgatcttacagaagcaaaaagtagaacagaggaaactagaggctgggataggcaggaggaagaggggttagggagaaattggttaaaggatagaaatttagagctagagaggaggaataaattctagtgttctgtagcactgtaacatgactatagttaacaataatgcatggtttcaaagagctagaaagaggatactgaatgttcccagcacaaagaaataatagtgtttgagataatgaatatgctaattaccctgatctaatcaccgtatattatatgtattgcaacatcactatgtaccctataaatacatacaactattatgtgtcaattaatttttttttgagacagagtctcactctgtggcccaggctggagtgcagtggtgtcatctcagctcactgcaacctccgcctcccaggttcaaggggattctcatgcctcagcctcccaagttcctggaattaaaggtgtgtgccacaacgcccaactaattttttttatttttagtagagatggggtttctccatgttggtcaggccaggcaatgatccacctgcctcggcctcccaaagtgctgggattacaggcctgagccatcatacctggccaattaaaaaaaaattttttttaaagaattctctagttcattcctactatattctgggcaaaagctaaacatctgtgccagacgcatttattgtctttctctctctcaatctctctcctttcattgaagcttccctttaattcccaaataaatccaactcccttccatattgaacaccataccactgactcagcatcatttacatcttgcagggaggttctttctctgtctttttccccttatctattcatccatccatccatctctttctctcatttcattgccaaatatttgggaaagcagtccaaggttactgctgcctttgcttcttcacctctcatcctctccctgaaatctgatctccctacatctctcattttctctcttgattcttcttctggtgatttcttcttaaatgttaatgttctctaggttccaacttgggccctctttttgtcttagtctacatgtcctctctgaatgatctcatccacgaccatggctttaactataacctgactctagtgattcaaaaatctttctgtccaacaccaatctcttgtctttactttagaattggatagccactgcatactgggtgcctatagctaaacatccagctatctgtaagtcttgtaaacacaacaacggtatggaaatccaactgaaaaacactcatgcccagtggaccatgaatttaaggcaagtctgatggtgtgagaaaagcataaaacccagtcagaaaccttgggttccaatcccagctcaattgtttttagtcatagggcaggtcctctatctatctgactgtgatttttcacttgtagagtatggcttactgtactttaaagattttctggccgggcgcagtggctcacgcctgtaatcccagcactttgggaggctgaggtgggcggatcatgaggttaggagatggagactatcctggctaacacggtgaaacctggtctctactaaaaataccaaaaaaaaaaaaaaattagccaggcgaagtggcaggggcctgtagttccagctactcgggagggtgaggcaagagaatggcgtgaacccatgaggcggagcttgcagtgagctgagatcgtgccactgcactccagcctgggcgacacagcgagattctgtctcaaaaaaaaaaaaaaaaaaaaaaaaaaagattttctgtgagggattaaatcagataatgtatgtaaaggtgtgatgtaagctggtaagtgttattccaatttctgatatgctattatttaaaatgtagttggacaagcaggagtaacatttaaaatgagacaaaaagtacaagccaccagaaatgcaaatatcaaattaatttgtcccagtaaactaaatataaatagtttttacactttaatgtacatctgaaagagcttattaataatgtcaatgcttgagctacagcccagatttaattggttgggaaagaggtcagtaatctttacttcaaaatcattccaattgtcacaggcaagtcagggccacacttcaagaaatagtgaaatataatgcacttgagggatggtcaatcctcaaaatattctaaagacttgtaaaggcttcagaactagttccttcttgagaagcacattgcttcttttgctgagttcaaattgtaatgaatttcaaggcttccaattctgggcttcttacataaagcaatcattccttcctcactcccaacacaaacacataatttttaatatataaataaatatatatatttacatttgcatattctgttttcattaatggaatttttttcctgtatactacatgagtaataatgtaaagacacgaaataaaacagacactaattaggcatgtttgaacatctgttgctaccaaacattttctatttctcttttcatatctctgctgatgggtttagatgaaaagactacaagcctgcatacttacagggaggaaggagccaaactggaaaaccagtagcacaggtcggtaggaattaatctcagcaggctcgcttcagcattcggagacacaaccagcaaaacacttccaagctggtggctcagttaatatgtgaagctatttttagtacaacagagagcatttctagagattgagattataaaccagggatacatcccaaacatattaatatggttttaattttattttacagataccatgtttcagaatattttaatctccatgtgaataattgtttttattttgtatgtatgcatgatgtaagtatgcatacagtacatttatatgcacgagcattattcatatacatgcatacctacatgtaaaaatctgggtaagagagtaaatcagatgttttagtccttgtatatataaggtaaaagccagaccttttaatgacttacacatttgatcaggaagttttgtgttttgaaatgacaaaaacttggaatattttcgaaaggagtagaatactttcggccataattttcatttttaagatgccttaaatgttttagttccttttaataaataatcttacacaatgagttggttctcactgtcgtattaggtaaatgggttttgttgttgttcgtttttgctaaaatgggttttgttgttttttgtttttgctaaaacgaaaaaacttcctttttattaaggaagttatatgaaagtccatcacttccacaaattaggaggctacactactgcaatttggctgaatcagtggatatttttaatgttgcttattttgtgctttaaaattgcagttatcccagagcatctgtaattttgttttttttttattttgaacaaactgttatctgttaaattaacaataagaaaaatgttattttatctatgtttattcattcttcaaaattcttccttttgttttttttgtttttttaattttcttttttttattattattatactttaagttttagggtacatgtgcacattgtgcaggttagttacatatgtatacatgtgccatgctggtgcgctgcacccattaactcgtcatctagcattaggtatatctcccaatgctatccctcccccctccccccaccccacaacagaatgatgatgagatattcctggtaagatgtaatgttttatttttcttcctggatctatctctgatcttgttccagggcacatcaatttagaaacactcatcgattatgatagctttgagaacaaacattggaacattaacatgctaattttgttctttacaggttgatggtagaaaatgtataaagtttaaaaacatgcaagtcttattagcattctgcttagataaatacaatcttattttatttctctctccttttattcatgccctgccaattgagagtgccaggtttctctccttttctgtttcacagcagctccaaagctaaagggaaaccaaggtggaaaataattaccccaaaagagacattttccatgacactaatggctggatttcagatactttccaaagctcattggaaagggagaactcatggagaagaaacaaccaactttaagtatcccattactctcagaggttgactcagagcctattccatgtagaaatactgaagagggtgtaaaaaagaacgaaaagcagaaacaaaataaataaataaaaacaacatagtcatgctttgtttatccttctttcccttgcaaacatctgctctctggagtctgctctggcatttaaggagcttggaagtcatccctcccatccaatctcacaaagaaaaaaaaagctgaagaagtaaaaaccaacaattcctctgaaatccctcagaggattgatgtcagagggcaaaccattgaccccatgattggagacaaagacagaaatgtacagagaatcatgacctagagtaacagaaacctttgggaaaaccaacattgggatagaaaaacttaaactgcaactgattagttgttcgaggctcaatgtggattaatttgagcattaaaaactcctttgaggatcagggagcagttttaagggggctaccacacatttgtgacttttacttccaggagccctactaggtttgcacaatgagggtcagggagaaatttcctaatgcttccaacaaggaacagggaaaaagtaaccattccgaaatacacccaggtcactctgttcttcttatggcctgtctcaaaagaaactgtattacccagagcccaacagactgagattatagcagagcctaaaccaccggggagtagggaaatatccaactccagcccctctatccttcccattgcacctaaagaggaaaaacccccaaaacccaaggagcacatgtggagatcatggcccaggggtagaggctcactgtgggactgggtcctaatcatcagattatacaaagcatcccccttcccctgcaccttaccacaataccagtagggctcctgtataataacagatgaacgcaacggaaagaactgtatgacccatgccttatttaagaagaagtttctaggaaaacccaaagacaacagcggggaataaaaacaaggacatcagaggagatgttagcctctaaagcctctagctacagcaaacagtaaacacagctcaattactagccagataaacataaaacctcacagtaatggcctgtatgcctcatttatttagtacatcacatcctactgtcaacaacaaaaaaaattccaaggcacactaaaagacaaaaaacacagtttgaagagtcagagcaagcatgagaaccagactaaatatggaaaatatatgggaatcatcaggtatgaaattaaaaggaactatgatgaaattcaagaaataaaaaacataatagaaatgaagaatgaaaaattagttcatcaatagactggacatgattgaggaaagaatcagtagagtttggacatgtgtcaaaagaaacctccaaactgaaatacaaagagaaaaaaaagtataaaaaagacaggaaatgtcaggcgcagtggctcatgctgtaatcccagcactttgggaggccaaggcagtctgatcacttgaggccaggagttcaagaccagcctggccaacatggtgaaaccctgtgtctactaaaaataccaaaaaaaaaaaaaaaaaaaaaattagcacatggtggctcatgcttgtaatgccagctattaaggaggctgagcatgagaattgcttgaactcaggaggcagaggttgcagtgagccaagatcatgccattgcacttcagcctgggtgacagagtgagacactgtcaaaaaaaaaaaaaaaaaaatagagagagaaagagaggacagaacagaatgtctaaaaactgtgggggtaattataatataaaaggcataacatacatgtaatgggaaaatcagagaagaaagaaaagaacagaagacatatttgaagcaataataactgagattttccccaagttaatgacagatattgttatgagcttaattatgtcctcctgttcccccagcctcaacttatgtcaaagccctaactcccagtaacctcagaatgtggctgtatttagagataaagccattaaagaggtaatgaaggtcacatgagatcataagggtgaggtcccaatccaatatgactggtgttgttctaagaggaagagactcaggagatgggcctatacagggaaaaggccatgtgaggacacgggaaggtggccttctgaaagccaaggagagagcctcaagagaaatcaatcctgccagcaccttgttcttggacttccagtagccagagcacttctaccctcatatttattgatgagataataaatttctattgtctaagccatacagtctgttatattttgttatggtggctctagtaaaggaatccaccaagccacacaacaaggaaactcaaacaacaccaagcacaataactatcagagcaaccacagacatatcacattttgacttcagagaaccaaacatgaagagaaattttgaaaggagcgagggtggatgggatgagggaaaccttacctggagagaaaaaataaaataactgctttgaatttctcatcagaaaccatgcaagcaagaagagagtggggtgatagatttaaagtctctaaagaaaaaacccattaacctagaattctgtatcttgtggaattatcaaaagtgaaggaaaaacaaagactttcttagaaaaacaaaaactgagagaatttgttgacaaaagacctgccttgaaaagaatgtttaaaaacagttcttcagaaaaagggagaatgatataggttgaaactacataaagaaaggaagactattagagaaggagtaaatgtacgtcaaacaaaatctctttatagaaagtttcttaattgatctgatggataaaaaagtgttcaaaatgataccagcaacaatgcaattggtggttatagcctaaaggaaaggaatgacagcaatattataagagataagaaggagaaagtaggaatactctgttatgggatagttgcattacatgttaagtgtacagtgttacctaaaaatggacttggattcgttgtaaatgtatattgctaactctagaaaaactgtaagacatttaaaaggaattataattgatactgggcaaaaagggaaaacagaattatataaaatgttcatttaaaatcagagaaggcagaaagagacaggaagacaaaaggaaactaatataaaacagttataaacattaatgtaacagttatagatattaaaccaacaatattaataaccactttaaatgtgaatgatatacatcaagtaaaagacagggactatcagagtggatataaaacagaaccaactatattctgtttagaagaaacttgctttaaatacaaagacacagattaaaagttaaaggatgaggaaagatatgccatgctaaaactaatcaaaataaagctaaattagataaattaatttcagacaaagactctagaaaaaacatttttcagggataaatttcttttattgcataacaacagaaggttcaattctccacaaagacataacaaccttaatgtgtatgtgcttaacgacagagcatcaaaatacttgaggtaaaaactgacagattacaaagagaaatggatgaacaattactatcactggaggcttccacacacatatatctgtggttgacagatctagcaggcagaaaatcaggaaggacagaatcaaactaagcagcaccatcaatcagctgaatttaatggccatttatagaataattaatgcaacagcaacagaatctatagtcatctcaagttctcatgacatgcaccaagatagaccacattctaggtcataagacacaccttaaaaatgtaaaagaatagaagtctttcaaagtatgatctcaaacaatagaattaaactagaaatcaacaacagaaagaagctggaaaatctcaaagtacctaaaaattaaacagtacacttctaaacaacacacgggccaaagaagaagtctcgggagaaattttaaagtatttcaagctaaatgaaaatgaaaatacatgttatcaaaattcacaggatgtagtgaaagcagtgcctagaaggaagttgaatgcatatattagaataaagaaagatctaaaatcaataatctaaattcccatcttagaaaactagaagaacaaaagcaaattaaatctaagccaaacagaagaaaacaaataataaaaatcagagcagaaatcaataaaattgaaaatcaatagagaaattcaacgaaaccaaaatctgggtgcttaaaacaattaatattgatgagcctctagccaggctaattaagaaaaaaaaaagaagacaccaattactggtataataactgaaaaggaggccatcactgctgatcccctttatcctaaaaatagtaaaagaatattatgaacaactcaaccccacaaatttgataacaaatttttggttcaaaaatttgaaccaagtttttgaaagatacaatctactgaaactcacactaggagaaatagataatctaaataggcttatacttattgaagaaattgaatcaacaataacaacttaccaaaacagaaagccaccaagcccagataacttcactggggaattctaccaaacatttgaggaagaaataatactccgtacaatctcttccagaaaatagaagcagaggaatattttctaactaattctacaaggccagcattactctaataccaaagtcattaaaaaattaccaaaaaggaagactacagaccaatacttctcataaacatagatgcaaaaaccaccaacaaaatattagcatattatatccaacaatgtataaaatattatacatcatgaccaggtgatatttattccatatatgcaagaatggttgacaatttatacattaattaatgtaacccatcacatcaacaggctaaagaaaaatcatgcaatcatatcaatacatgcagagaaatcatttgccaaaatctagcaccagtcatgataaaaacccttagcaaactagaaatatagaggaatgctcccaacttgataaaaaaaaatgcctacaaaaaacctacagctaatatagtacaaatgaaaagtctctcttctccctgccctcatgcctaagtcagagtctcctaaagaaccgaacagctgaggaagctcttcattggagggctgagctttgaaacaaggtgagagcctgaggggccattttcagcaatggggaatgctcatggactgtgtggtaatgagagattcaaacatcaagagctccatgggctttgggtttgtcacataggccactgtggagaatggggatgtggccatgaatggaaggccacacaaggtggatgggagagttgtggaaccaaagagagctgtctcaagagaagattctcaaagaccaggtgcccacttaactgtgaaaaacatatttgttggtggcattaaagaagacacagaagaacatcacctaagagattattttgaacagtttggaaaaattgaagggattgaaatcatgactgattgaggcaatggcaagaaaagaggctttgcctttgtaatctttgatgactatgactccgtggataagacggtcattcagaaataccacactgtgaatggccacaactgtgaagttaggaaagccctgtcaaagcaagagatagctagtgcttcatgcagccaaagaggtcgaagtggttctggaaactttggtggtgatcgtggtggtggttttggtgggaatgacaactttggtcgtggaggaaacttcagtggtcatggtggctttggtggcagctgttgtggtggtggatatggtggcagtggggatggctataatggatttggtaatgatgccagcaattttggaggtggtggaagctacaatgattttggcaattacaacaatcaatcttcacattttggacccatgaagcgaggaaactttggaggcagaagctctggcctctatggtgatggaggccaatactttgtcaaaccatgaaactaaggtggctatggtggttgcagtaacagcagtagctacggcagtggcagaagattttaattaggaaacaaagcttagcggaagaggagagccagagaagtgacagggaagctacaggttaccacagatttgtgaactcagccaagcacagtggtggcagggcctagctgctacaaagaagacatgttttagacaaatactcacgtgtatgggcaaaaaacttgaggactgtatttgtgactaattgtatgacaggttattttagtttctgttctgtggaaagtgtaaagcattccaagcattccaacaaagggtcttaatgtagatttttttttttcacccatgctgttgattgctaaatgtaatagtttgattgtgatgctgaataaatgtcttttttttttaatgtactgtataaagttagtctgctctgaagccatcttggtaaatttcccccaacagtgggaagttagaattccttcagggtgatgccaggttctatttggaatttatacacaacctgcttgggtggagaagccgttgtcttcagaaaccttgctatagttgaactgatagttactgttgtgacctgaagttcaccattaaaaggaaatagccaagcaaaatcataaaattattggttataaaaatgagtgttggcacatcttatgcaatatactaaattgaataatggtaccagaaaaaactatagatgggaatgaagattgtgtaacatctattatcatgtgtaatcaataaatgatttaattctcttgaagaaaaaaaaaactagatgctttcccactaaaataaggaaaaatgcaagaatgtcccctctcgctactcctatttgccattgtactggagtcctaggtaatggaataagacaagaaaaagaaaaaaagggtatatagtttgataaggatgaaataaatctttgttcaggaagacatgtttgtctaggtagacaatctcaaagaaacaacaacaacaaaaactcttagaactaagtgatcatagcaaagttgcagggtacaaaaaaagtcagcggttttcctatgtaccagcaatgaaaaattgaaatatgaatttcaaaacacaatactatttatgtaagcagcaaaacttaggcatacatctaacaaagtatatagaagatatatattaataagagtacaaaattcttttaaaagaaatcaaagatcaaaatcaatggaaagacataccaaatatgtggataagaagactcaatattattaagatgtgagttctttccaacttgacctgtgaattcaatgcaatctccatataaatcctagcatactttgaggatattgacaaaccgattccaaagttgaagtggaaagcaaaagacccaaattacacaacacaatactgaaggaatgcaatgacagagagttgacactaccaaacttcaaaacttactataaacctatagtaatcgaggcagtgtggtattggcaaaagaagaaaaaaaataaatcaaggaaaaagaatagagatttcaggaagagacttagacaaggtagaaaaggtaatcgaatggagagaagatcctattttcaaaaaatggtgctggaacaactagacctctacatgcaaaaaaaataaatatagactccagattttactaatttcacaaaaattaacttaaaataaattatacaactaaaaataaactgtaaaactataaaacctttagaatataacataggagaaaatctaggtgaccttgagtttggcaatgactttttagacacaacatcaaaagcacaatctatgagaaaaaattgtaagttggaatttattaaaatttaaaactttgattcttttaaatacaccattaagacactgaaagacaaactacagactgggggaaaatctttgcaaaacgtatctgataaagcactggtatccacaatatacaaggaactcttacaattcaacaataagaaaacaacacaattaaaaaatcggcaaaatataatatctgaacagaaaactcaacaaagaagacgaacacttggcaaatatgcatgtgaagaggtgctcaatatcatatgttattagagaactgtaaatttaaaaaacaatgagataccacatctattaaatgactaaaatccaaaacattgaaaacactaaatgctggtaaggatgtggagcaacaggaacttgcattcattgctggtgggaatgcaaaatagtgtagccactttggaagactggaagtttcttacaaagctaaatatactcttaccatatgatccactttcctaggtatttgctcaaatgaattggaaacttatgtcttcaaaaaaattctgtacatgaaggtttatagcagctcaactcgtaattgccatatgtggaattgattaagatgttcttcaatgggtgactggataaactatggtatattcataaaatggaatattcagtgataaaaagcaatgaaatatcctgccatgcaaagacatggagaaactataacaaatcttgttaagtgaaagaagaaaaggctctacactgtgtaattccaaccctatgacattctgtaaaaggtaaaactatggagacagtgaaaagataagtgtgtgccaggggttagggtaggggtatggataaataggcagaacacagagaatctttagggcagtgaaactaaatggtggataaatgttatacatttctgaaaacccacagaatgtataacacaaagaattaaccctaatataaactatggacttttgttaacaattatgtattaatcttggctcattaattgtaacaaacatactatattatggtaagtttttaattataggggaacgtataggtggtactgaggcattttgttggaactctctgcatattttgtttaattttctgtaaactttgagattctctgaaaaaaatgaagtccattaatttttaaaactctgctccctagaacatgattttaggagccactaacacctggcttcaaaaacagacatgcagggatggattcattaaaagtgaatgacaaaggcttggaaagttcttcagaggacaataaaatagaactgtagaggccctcttacagctcttataaaacaagcaactgtgtaaattaaatgccaaatggaatccagatgaaaaaaaaaaaacacacacaatttgtcttaacggaatggatatatttgaaagcactgcaatgttttagataaagaaataaataatgtctacttttagaaaaatgaatttctttcactttccccaatatcttaaattctcagttttctaatattatagataatggaattattaatggattatgcagatatttaaggcactgttattttatcagctattcaaggttcaagacacagttctaaagtcatataggctattaatttggttttatgtgtttatttcaaaattcttttaaattagttcaccatgtatttgatctctttagttggtcataaatcccttgtcatctcttccccaaaacaaaactttggatatggcaagctttctaccaatggtaactgaccaacttaaaatctgtccctgaaggaaaaattactatttatctcaaatctgctataattattttatgtcagcctacaattgctgtggttggccaactagaatactttctttttgctggcctcttattatcatgtatgaaagatgtattgattctcaacatccttttattattactttagtatggttttggcaagtggaacttcatcttgtctagttgtttgggagcactagctacagtctttctccatgggtctgaaaaccttcacaacatactggagaaaagacaggccttccattgaacatttactgaggcataaatcatcaccctacaagataatgcgatgttttgaacaactttaattgtttaaattgggaggttcttatgtggggaacaaatttttccttctgcaactgtcatatgttggttttgccatacacaccagaaagtctgtatctctcccacacacatctctcccttccatactaaatatgtattttttctggctaaatattccttgtccttcaaattcaaaatttaatccaattcaaaaattaatgtggttaccatgatcttgacaaaatctacattgtaattaaggtcttttaagatagcccaagaaccaaatgtaatattaattgtattaccactaggatggcgtgagtgatgcagtcacctcaggtgcaaaatctaagggagtgtcaaaaaactcggtaatcaaaataaataatattttaatgcaatatttgcaaaaataacattaatcaaaataatattttagtgcagtatttgaaaaaaataaaaattaatgcaaaaagttcaaatggacaaggatttgggtgtgatgggtgagatgagtcatacaagtaagtacaggggaggctcctgtcttttttggacatttcaatttcttggagttaaaatcctatttggatattagagattcaacccttgaaaggagccagcctaaagacattgttccatttgtactcatttctttttttcaataataattttaatttttagtttagattcagggggtacatgtgcaggtttgttacatgggtatattgcatgatactgagctttggggtatgactgatcccaacacccaggtagtgagcatagtccctagtaggtactttttcagcccttgcacccctccatcattccccccaccagtacctgccagcgtctattgttctcatctttatgcccatgtatacccaatgtttagctccctcttataagtgagaacatgtggtatttggttttcttttcctgtgttaatttgcttgggataacagcctccagctgtatccatgttgctgcaaaggacatacttttattctttttcatggctgtgtagtattccacggtgtatatatattacattttctttatccagtacactattgatgggcacctatgttgatttcatgtcttcgctgttgtgaatatcgctgtgatgaacacataagtgcacatgtctttctggtagaataatttattttcctttgaatatatatccagtaatgggattgctgggatgaatatagttctagttttagttctttgagaaatctccagacaactttccacaatgactgaactaatttacattcccaccaacagagtataaacattctgttttctccatagccttgtcagaatttgttatttattgattttttagtaacagccattctgactggtgtgagatcgtatatcattgtggctttgatttacagttctctgatgatctgtaatgttgagcattttcttgtatgtttgctggctgcttgtatgtctttttttgagaagtgtctgctcatgtcccttgcccactttttaacgggattgtttcttgcttgttgtattgtttaagttccttatagatttttgatattagacctttgtcagatgcatagtttgcaaatattttctgccatcctctaggttgtctgttaattctgttgatagtttcttttgctgtgcagaaactcttcagtttaattaattagttttatttagtttaggtcccacttgtcaattttggtttctcttgcaattgcttttgaggacttagtgatgaattatttaccaaggccattgtccagaatggtatatcctaggttttcttctagggtttttatattttgaggtcttatattaatctttaatcgatcttgagttagtttttgtatatggtacaaggtagcggtccagcttcattcttctgcatgtggctagccagttattccagaatcattattaaataaggaatcctttctccattgcttatttttgttgacttggccaaagatcatatggttatagatgtgcggctttacttttgggctctcaattctgtttcattagtttatgtatctgttttgtgatgtgtataaaatggtcatttctaggaccctttgtgtgcaatgtgtgtgtccagaggtaccagtaaaaaccctgcctcggcttctgtttcagtttgctacaactgacactgtctctacttcttaccaaagctctcttgagttttcctgtgcctttgtctcgagcccacactgcaagtccttagtgctggatctctcttgatgagcaaatacatctgggaaagcccatttctgactccactttaactggcttgaattagaatgctttttgtacttgcacacaaaataccagaaatcttatccaacttgattttcgaagaatggagtttataaagatataggccttttagtccgtattggcttgtcttagttattgaacagaatcaaaacattccatttttctataaaaccaagataattatgaaaaagtagtttttcatatcaactgatctattgaggcttatgttcagcagaacctacttggtaagtttaaactggggatggaaacaggtcaggatactaacaaaatgaaataaactggttttttttgttttgttttgttttgtttgtttgttttttgagatggagtctcagtcaccaggctggagtgcagtggtgcaatctcagctcactgcaacctctgcctcccaggttcaagcgattctcctgactcggcctcccaagtagctgggactacagacgtgcgccaccatgcccagctaatttttgtatttttagtagagacggggtttcaccatgttggccaggatggtcttgatctcttgaccttgtgatacgcccacctcagcctaccaatgtgttgggattacaggcgtgagccaccgcgcacagccaataaactcttctttaacctgccttatgcaataaagtccctgtgccccaaagttgtcttagaaaagacagcctaagtagttactgtgctttggacttcacagcccaagtacatcacaccatcaatatcctctttaaaagccgggagtgaggttttataaaagtatgctttaaacaaatggcagcaggaaattcaaagttgggtaattcatattgctgctataatttgtttgcacctaaaaagaaaaatcgtagaaaatgaagcatcattgcctgcaggtacagacacgtatggtgtctgagatcattgttattctcttcctctcatttttctcccatatcctcttaatggaataattacattattgtaatttacttgtatataattcaggcaagctaagcacaaccaataatatgtttcttcagaggaaaaaaacccaaacataataattaaagaataaattagttactgtaagtagcaagtattccaggtttggggagaaagtgtaggagatgatcccctcagaaatggacaccagtggatggtaacatgtgtgggaacaagagtgattccatcttggatgctaatctgccatgttggctcctgattaaccctgagtctgggaatgcctccaaggtgtctagttgatgatttactctctatgtagaaacacttatttactctgagttacacctttcctccacaacaacccttgatcttgttgcatacattacccgtagctgtaacacccatagcattctctcggccacccactcattccttccagagcaaatatacttttcctccaggatatataaaccctgggtctggaaggttgtagtgcgaaggcctacctttcttgtggccacccaagaccacgcttctgtctgtaagttccccaataaatcacccttttccaacacactggatttttctgctctgttctttggtttcttggctccttctgtatttggtggacacttcgcatatatgaccctttcacggaacaatgtgaaacttaaacatgcagcattttgggacgatctactttaagagatgttctgtaaatgatctgctgtgtaggccatgacatttcctcaggctcaccactgaaacatcaacctactataaaatgataaaacatgtgctttaaatgtgagcactctaacatatttatgaaagatgacacaacagatgggcagaaagaaacactgagaatgggaattttattttctttataatttttttttttttttttttttttagacggagtctcactctgtcatccaggctagagtgcagtagcacgatcttggctgactgcaacctccatttctcaggttcaagcgattctcctgcctcagcctcccaggtaagctgggattacaggcacgccctaccacaccctggctaatttttgtatttttagtagagatggggtttcgtcatgttggccaggctggtctcaaactcttgatctcaggtgatctgcccgcctcagcctcccaaagtgctgggattataggcgtgaaccactgtgcccggctgggaatttgcttttcaacagggaaaagaggcagtgtatctgccaggcaataatgatgacaagcacaaaacactaatttcaatgtattgagtatgtgagaggaccaatactagtttccttagctgtattaatttgaattattttaacaactttaggaagtcaatatgatttctgtttgaaaagtgagcaaacttaggctcagagatattgcacgcctaaagtcacacagttggtatgtggttatgacagtatttatgttcaggtctgtctgcctccaatgcctgggtttttctctatgagctccctcttagctgttccagtgttcctccactagaatttcatattctttagtgagacaatctccaggcattatcctagcttgaataaaatgctccagaaagttctccaactcaaatctacaaatcagtagtcgttttgtaaaataacttctttctccaaggacctcagttttgaggaatgtgtgccctggatgaagaaactggcattctcactactggaaagaaataattttgtctccgtattaatttttcggtattctggtttttagatttttttttcatgagttatgttagtttcgactcttttgactagagcctgaccattcttggatgatcgactaaattcaagtttctgaaatgacacacatgagagatagctttattgattttctatgaattttcttattttttcttcttataaaaatgtctctccaggagcaacaccaaagaaagccaagctgctgcaaagcttctcactgcctttgtatattatgccagctcctctacctcaaacgcttgccctgccttctcatctgaaaaatctttcctcttaagatccagctcaaatggtaccagttctctcgcaaaatcattctggaagaccccagggaaagtcaatttctcattcttttaaacattcacataattttgcatatatcactctcctattcacttgacactctacagtaactccttctgtataatcctattttcccatctagcctgtgagctacccaatggtgtcaatgaactcagtcccctttgcgaacctagcatcttctactgcactggcataggaagaaaaatactcaataaacacttgcagaaatgacatttaaaaaccatgcaatcttgtctttgaaaactgtactgttcaggaagatctaagaagatgaatacttactaggggctctttttctccttgaagagcttgagtgaaataatggctgttgaaccaagtttgttctaagttcactgaacttgatttattagcattgaattttcttttttagcttttttttttttttttttgcttgtaattggcctcttcatgtttaacacaaccctccacctataaaaatcataggatacttcacagaacagtgagaaaagcggacccttgggacgtcaagggacttactaaaaagcacacagctaagtgggagagttgaactagaactctggttctatgggtctattttttattctttctagtaggccaggttgctatgacaaaacaataacccctttaagcttatttacagctctttaacctaatcagaaggctttctttaatagttgcagagggcaccataccacagagaaagttgtcacgaggtctggtgactttccaaacaaagccgcttatcaattcaatgttaaaaatattggtcccatcctgagaactgtggtttccttttcttaatgaaaaaagcaataaaacgcaagtacacatccatctacacatacaggctgtcaataataaaataatgagagatggcactgaccataatctgtgttttccggctcccaacaatttgatggccaaaaatagggggtctgcggaatgaaaagaagtggaacccagattagacaaataaaaaattagtggagtttctggccagtgaattacatttatcttccacaattctctatattagtttgctatatgttttataatacagaacatgttccaagagagacattgaaaactctttgtctacatgtactttgctgaccaattgctcagcttctaaacatgtgtagtaccagcaagcaggtatttagaatgtcatccctttgctgtaattttacaccaactgacataaaggcaaaaaggtctgattgtatattcaagcaaaaagtattcatccacagagaggactgaaagagtatgttcggcaagactcaggatgaaatatatttaaatataacaaattgttttctatgaatcatgtatttcaacactgcttttggtagctccaaaaagctcaaccaaccgatagactctttctctgagatctgacaatgatttgcctggctccattagtcatataattcagttctcagcattgtccaatgagattaaagcaactttttactctcacttttaaagacatttcctaaattcctcttgtaactaatttctaccatttagtcgtgcaacagggtgactcgagtcaatagtaacttaattatacatttaaaaataactaagagtgtaactggattgtttgtaacacaaagaataaatgcttgagggaatggagatcccattctccatgatgtgatgactccacattgcatccttgtatccaaacacctcatgtattccatacgtataaacacctattatgtacccacaaaaattaaaattataaaatttaaattaaaaaaacctacaaaaaataaataaaaatagaaacatttccttacaaagacacttgtttctctaaagttttaaactgcacaaatcagagattttttttaaaggaatagtgtcttaattgagtgatacaatctgcaataggcagaatccagattctgtagaatctagaaactgactgactaaactacaaagaaaatgtctgaccgagagaaactttattattatcattaacatttatattttctaaaaggactttcctagccctgctagctgaacatgcttggctcctgaccacgaagaaacctgatgatcacctgtctccttatcaacccctagtccctggaatgatgaggcctgcaggactcactgtaacagtgatggcaaatatcagtactgtgggcttaattctatctgttagctaattacactaactaccatgtgcaataagcatatttggagtcatctctgattatctgatcattttcccctctagaagagagactctaaagaagggaaaatgggtagatagggagaactgtttgaatctctacagaaaagtctttccaaactgtctcagaggcccccccgactaccatcacccagggatttcaacttaccctccgttctttcttgggaattacagtagtaaaataaagaaggctactaacagtagttttgtgaacatgagaacaaaatcatcgtaggaattctgaagaaagaaaaaaagactaaactgctagacaaaagaggatagtaagactttatgtgggtcacccttatcaccccaatctcacttgactccataggagatgaagctttgagaattcgatttcttaaaaataaaattgaatcaggattctaggatagccctagggggacaaagtagttaaaactttgctttcatgtagggtgtcactttttttttttttgagacagggtctcactctgttgcccaggctggagtgcagtggtgcggtctcagctcgctgcaagctccgcctcccgggttcacgccattctcctgcctcagcctcccaagtagctgggactacaggtgcccgccaccacgcccagctgagtttttgtatttttagtagagacggggtttcaccgtgttagccaggatggtctcgatctcctgacctcgtgatccgcctgcctcggcctcccaaagtgctgggattacaggtgtgagccactgtgcccggcctaaaaacgattttctgatatgctatttcttaggttttataagagatatatttctactttggtatctttctttttttttttttttttttttttttgagacagagtctcgctctgtcgcccaggctggactgcagtggcgcgatctcggctcactgcaagctccgcctcccgggttcacgccattctcctgcctcagcctcccgagtagctgggactacaggcgcccgcaccacgcccggctaattttttgtattttcagtagagacggggtttcaccgtgttagccaggatggtctccatctcctgacctcgtgatctgcccccctcggccccacaaagtgctgggattacaggtgtgagccaccgcgcccggccggtgttactttctgagatgcttcttacggagtgcattgttccctctgggtagtttctatattttggggagtatatatgtgtatgtataggtgtgtgtgcaggcatatctatttatctaaccttaaaatacctattctactcagacaagacatatacttttttcccacaaaagcacaaaaaatattctcaactgcattcttatatttttcttcattctccatcatttactttagtgagaatttaatgactgtaaaattaaagcataaagtaattttttcttgtgatattatgtggaaatgccactaaaccaatgttcttcactaatatggaagattttttctaagaagtagtgttttgatctgtagtaaacgataatataggagaacaacaaactcttacagttttttttggaatttaaatacatactttcatagttctaccatacattaggacattttaatgcatgagtttcttgatttttcaatattggcttccttagctaggatgaaactcatccaaaactgttcaactgttgttcaataactgttggagcatatactaatgtattgaaagtcatgaaagagagctaaagaattacatcagatctcattttcagttagctaagagaggatgattagacaattgtgactttacggtaaatttaaaaaatcacatgattaagacatgtactacaaatttgagacaaatatataaactgtcatgccaatgaaataaagatttctgtttatctcaaattaatgctttgaagactctttagatttttttattattattattttgagatggagtctcgctctgtcacccaggctggagtgcagtggcaccatcttggctcactgcaaccttcgcctcctgggttcaagcaattctcctgcctcagcctcccaagtagctgggactacaggcacgcaccatcacatccagctaatttttgtatttttagtagagatgacgtttcaccatgttggccaggatggtctcaatctcgacctcatgatctgcccacctctgcctctcaaagtgctgggatcacaggcgtgagccactgcgcccagcctagattcttaatgatggttagactcccaatcattcactggaggatttgtaaacacggcatcccaacttttctactttaatttatgattttaaaatatccttccaaggagttgaatttcacttcggtgtaataaagaactttcgctgcttggaaccaacgtaaaaacagaagtgaagaccttgaataataatttgttttctattattggaactcttcaaatatggactggttaatgacttggtagacattatagtagaaattcagttacctctgagttttctggtgttttttaaaatcttggtttcagaactctaatattattagatttacaaatgtgtttgttatatttagatactatttcaaatatggatgcatcattaaaatatgtaacatttactatttagcactaatgtaattttaatgtgtatatgtatagatagtttattttatatctgcctatctatctcagcacactgaacttgacaactctctgtctatccctagtagttacataattcatatgtcatttgtacccattcccttgctttgttctaaagctcttttaaaaattctctccttttctcctgtgtgtatggtgatcccttccttcacatggcttttttttttttttttttttttttttttttgagactgagtctcgctctgtcgcccaggctggagtgcagtggcacaatctcggctcactgcaacctccatctcccaggttcaagctattctcctgcctcagcctaccaagtagctggaattacaggcacatgccacaacacccagctaattttttttgtttgttttttttttagtagagatgaggtttcaccatgttggccaggctggtctcaaactcctaacctcaagtgatagcccgccctggcctcccaaagtgctgggactacaggcatgagccactgtgcccggcctcggtgcccttttagacccatgagcatgactaagacatgtaaaccttgtctgtctactacattttctgggaatagagatttctttaaaaaaatcaggaagcattagtcacataaaaacaatttatttgctgatcaccaataattcctagttattaaaaatttaatcttggggccagaagttactttaataatatgctattttaagctaccattagtgtaagttttgctgtataaagaataaagctccattaatgtaaagcttttttaagttacgtaatttaactaagtgcttgaatacttaggtcagtatcacagtttcaggatacagctttatttcctcctagctcttaagtccaaaactgtcctacgattatttgccttggaagaaatgagtccaaggaaggggcagtgagactgttctatgaggacaataatctttaaaatgattttttaaagcaaatgattaaagtgatttttaaagcatatttcctctttgttctcagttttcccaaacaaattttaggtactctgattactattcagtcatttatgtagacatagagcatttaataatacttagaacaagtgagaagaaggctccaaagtctgaaagttggactgtggggagaaccctccagcaaatacctcttggaaatggattagagtttgacatccagcattttatgtgccttaattttacaggctagaatctgctaatcagttattaatgagccataatgtctactgaaatgtagaatatactttaggtaaatcaatgtgaactcaagtgtcaaatatacttacaatgactgaaatcagagtccacaatcattgccagaaagaataatagcatctgtgtcatttgcaaatgacctagaatgactcttatcagtttgcaagttatctgaggtgtcctgttgcagttgagtgcacacacacaatatatcatcatgtcagtctttacagatttgtagaagagcctaggatgctgagagtttattaattagctgaatcctatctggagtttcaagcattcctgttaaaatttacttgggctgaagatggtctggatcacaggcaagggtcagacagaggaagactctccggtccttccgaatgccattaagtcactttatgaatttcccttaagcttttcatataaaatagaaattcaatcatcacacaatttagctttcacacatcatcttgactaagcatactttatctttctctgtgtttattgctttttatgtctttagtttaatgttaatcagtttctaactagcctaagtcaaagtaaaataagtcatagtttttaaaagttctgttcaaaagaaacctaactaacaaacgaaatgcgggcttctagtttactgttaaagaacatttctaataaacttacttgaaaccggtaaaaggtgccatcatccttgagtgtgaggacatgatctgagattggaaagaagtagccgtgggcagccattaatgttcccaaatggagcgcctccactgttttatgaaaacaaacaaagaacataaaaaagccttttaaatgtattcttttataggaatgtaacgtttttgtgtggttccttttgtcagatacagtaagttcctcttgaaagatttaatttctgacttccttgttctttgctctcgagataaacttccttgtcccttctcctaagctacctgctctgtaaacaacttctcctaccagtcccagtctgtaactcacatctcttccttatttggaaacagtcctcctttactcctggctacccattctgtaaactgcccctcccactgaaacaggtcttccagccaaaactacacttcctgcctttgccgtgccctgacatgcccaaacatgccttgtaccgaaacggacagcctctcccttcccacctaattagccatattcaattttaaacagtagccaatcgggtcagtttagattgtgtggtacgactccagccaatggggacaggacacagaagcagggactaatagcgttagggataaaaaccccttccctcctttgttcggtgtgctctcgcagtggccagaagtgcgagtggcacccttctgcagaagtaaatttgccttgctgagaaatcctttgtttgagtgctcgttttccttgcgactcccagctcttgtttctaacactttagagtacattcttggcattctgaaaacctggctttgtgctttttcttcttttttcagctctttctcacaagacactaagatggttctagttcctggtagcaactgccatgaccaacctcatccaatgacaacaagtccatgagaagataaagttaagaaacattaaaatgggaaggctcttctcaatctgtagagtatgtctccctcattttatagatgtgtgttggcccatgtgataatgttctctcacaggcagttgcatttggcatttatagcactttaaacttttaaaagttttcacttgcatcacctcattctcaatatcatagcaatctagtaccatcagtaatgtttctaatgatatggaccattattttgtgatgctatgagggaatgttaaggcatcaaggaccatgtatgctgcactattgaatctacagactggtgattgtaaagattgttctagcttttactattctatacagtgttctaaatatggagtaggaagagatttattggacaatgtaaacatatagtctgaaactaaggctgtaatactcatactgtttatagctgccaacaatttcttccaacaaaagggttagtaaaatttggtcaatagttattactgcgtttgtgcagagatgacataaagttttctaacttaaaggctagaaaatatgaaattatgcaaaatagttttctaccccaacaaaaaaaatatatgtacagttgtcccttggtatcctcaggggattggtttgaggacctgcacagataccaaacatcaaggatgctcaagttccccactttgccctcccacatctgtggatttttgatcatgggtggttgaatccacagatgtggaagtcataaatagagagggcctactgtatgtagaaaataccagaaaagttagatttatttatctgtttatgtatctttatgtataattcatttataaatttatttctgtttcttagtcaagaagctaggattcttacagcagttctaggacaacatggatctatctatatctccagccatcaaccatggggagcttttacacctcagttaagaactgagtaactaagtagctagctatggtacagcaaagcataagaatcccatccttttaccccttacacctacataaataaacaatttgttgttaaatttttatctgttttggggtactatgatgccccttgaaattgttatctagcattttgcaaacatttcaattgataacttctacctctgatctctccctgcattgttcttgccgataataaagaacaactgccaattattcttcattctttgccctggctttggaagactgttactaactgctccagccatcatctccaaactcgcagtcaagtctctctgtatagaatgttgttttttgtacagaggagcatttttttttcatcaattttgtgcgtgtgtgtgtgtgtgtgtgtgtgtgtatttccatcatttcaacatcctttcagttcaaagtcaaggccttctcaaagcatgcattgctcatagcaacatgcctacctatccttgttaaaactttagtgccagggtgtcattgtggaaagaacaagaactttggagacacccactgtcttctgttactttcattctctgtgcctcccccatctattaataaaggtcataaacctacctggcaggattgacgtgagaatgacataagcacacttgtaatgaaattggaatcatgcttccagcctagtaggtactatgtatatggtagctactgtgcttcattatttacacacaaaataatttttacttttctacaaaccactttcagagaatctacttccatacatttgccttctgctaggttgagtgaatatttccaacacaaaaaaaacataaaactttgaagtgatagatatgttaattattctgatttgatcattgcacatttcatgtattgaaatattactctgtaccctataaatatctaacaaaagttttaaaaagctaggctgagtgaggaatcctgacagtcctaagcagccacgttcatcaacatcatcttattctctttttttttgactgtctgtaaaattaaaatggtaagaggatctagaaagatagttggcccataacaaatgagcaggtggttatagtcctggttaaattctgaatccctaagtacccctgtggacgagtgaagaatatgccatcccaaaataccccagattgtttcaagttgaaaacactggatgaattgtagtttcagaaagggctagctggcctatctcttcctatatgcagcaagccataaagattcctctgggaggggtatcttgcttttgccagggcaagaaaatagctcttatcaccagagactgggagttgggggctgcaatgaacctgaataaagggctggatgcggtggctcatgcctgtaatcccagcacttcgggaggccaagacggatggatcaattgaggccaggagttcaagaccaccatggccaacctggtgaaccccgtctctactaaaaaaaataaaaaataaaaaacttagctgggcatggtggcaggcatctgtaatcccagctacttgggaggctgaggcatgagaaccacctgaattcgggaggtggaggttgtagttagcagagatcacgccactgcactccagcctgggcgacagaacaacactctatctcaaaaaattaaattaaattaaattaagaaataaacttaatcaagtaacccctactttccactagttttatgcccccaatatattccctagtgattctgctagaaaatttactgccttcagccagattttctttgttctgtcatttttttcttaaatttattattgtttgtctaaaaagtatagaagtgtcttgctttggccatttcttcagacttcacactcttgtgaagatccccatgtacatgtaaaactaataaaatgtgtatgattttctctattaatctgcctggtatccacctggtctccagatccacagaagagcttaggggggttgcagatgatctctgacttccttacacctgttagggaatatagggtggggcaacatgtaacatcctttgtaggtggcccatctgtcttcgtatagccatctttattattttagtcccagcagtctgtggcctgggaagatagtgttagcacactttcccggaagaaaaattaagttacggcacataaggaaatctgcggagtatagatacaagaagggaaaactgagatgcccaggaagatagacagtaagaggagcttctgagttctaagcataggaaagagtgtgactaaaaccaagccaaggaacaacaaaaagcaattgggtgttaaagtgttgatgaggattagaaaaatagagtgaaagtaaatatagagatgctacaaaaaagaaaaacagaagtgagtgatcataagactattcttgactcctgcatctcattaactactaatttacaagttatatacttatagagtgcaaagtgtatgttggcaggttcttcttcatgtaatactaccataattagtcattaataaatgcttgcaaatgagtatgagtgaattagtaaaattctccttccttttttgaggtacaatattttcatttgatttgatgatatgcattctcattttacttctcttctgagtgatacttatgttccataattttacaattaaggaaaatttgttttgatacttttgcatcatgtcatgaatttagtagaaatatactggtggtgatacaggtaagacctagatttaatttctatgtgagtcacacacatttcatatgtcaaggtgaaatcaaaccttttgacttaatagttaagaggactgatcttctcacaatgcttacaaatggttttaagatttttggtcaaatagtaatctagaggtactgaaataataatagatattttgtgttcattacaggatctccagaaaatatagctccagagcaggataaatgcctagatgaaaaatcagaaagttggggtgaattttttgcttcatttaggatgacaagtttagcactcagcatatccatggcaaaagtagcaagtgaatcaatatttgctaaatcaatgaacaaggacatttatgagtaaatgacacaccaagaatattaaaaacctaacactgcatagaaaaacaccaggctaattattgtgtgttataagctgttgaggtggggctattgtagctattttgttgtgagaaaatataatagtgatattaacaagataaatgccagtaagaatggacttggggcagtattctcaagacagacttgtttattgttagggacaaacatggtgccacagttccctgtggtcccactgctccgaaatcttagcaccatcttaatctaataagaatccataagaccgctgacaatcttggaacaaagtgttgaaagagtttactgagtaatctgtcaagatcactctcccaataacggcacaccagatggcccagcagcatcacgcttcacggcaaaataatcgctaattaatcttctcgtacatgtgttattctcttcacccacacagctaaagttcaacaataaacctactaaaaaattccagcttatttttttgtttggatattcaagccatgagcaagctgagaaacaaaaatcaatctccaaacacctctgattaagtgaacagcctagaacagctttgttaagcctgataccaacataggatgatttcaccccaaactctaaaggaatggtattatcaacatcctcggatagcgaagagaattctccacagcataatttgcttttgaccacaacgatttcaaaaagttaacaggatgaaaaccacagtataaaagaggcttgtggaactccaggggtgcaatcggttagctcacggtgcttataaaagaggcttgagtacttgagtgtaaagtactctatatttacaatgtaattttaaaactcagtaatatttttcttacccagaggctcaacttcttgcagcctcctcttcttttaaatacagctcataattttgcaacgattaataaaatgcctctgagtcaagaaagtaatttaaaaacttcactgaatcctgtatttttatcactatcatgttatttactcttatttatgtgcatgtattaacatttttttcatttccaacacagtataagtatcagtagtgtgtggggagaaatattttaaaagaaaatctaaaaagaaaaaagatggcagctgattatattaaggaaacagagatgctaaaatgaagacaaaggtaagttacttaatgataaaataacaggtattcatcaggacaattctgagccataaaaagaagatatgttagacttgttactttctgtttaagaagacatggaagtggtcattttagaaatccttcaaaatattatgctttattttttagaactggcatttggaaaggtaagattattcatgtagaaaaatctcatatgcggaacattttattctccaacaaaaccaagtaaaaatggactattaccatatttagaaatttctgaagtaagtttattttctcaacagtaggagttagtaaaagaagtacctcagctttcatctttttaaaaaaaacatcatttgcatgtaagaaaaatcaagtgccgctttctcaacagcaatcataattcgggatagagaagtgaataataaggtgacatagaatagataagctaaaagagattctatttgggagaaataaaaacagaatcataatttatatcaacattgaggaatgcaataagaaattaatataagtaaacgctatttccaaaaaaggagcagagtacaaaggctatgccagtcccctgcctaggttcacatcccgggtccctcatttgctggctgtgtgacctgagcaagagacttggattctctgggccttggtgccctcatctgtaatcatctgtaagaagttgacaaaataataatgccaaagattagcagtaaggatccattgagataatatgcacaatgcacttaaaacacagtctaccacacagacatgctcctgagatgagagttattatcagttgatacttatgaagtgtcacattcaggagcacttaatctagtttaaggggcgatgggaaacattagtagctagtgttgctctgggtttcccagtcatgttaaacacttccaattcaactctattttaaacgccccaggtgatcaaaccagagtgttttgtgggctgaaatatgcctatgtttttccctacagcaaagaacactaacaaaatcccaaaaagaaattagggacaaacttattatatatcacagggatagccacagatttccaaaggcggcatgctccacacgctaggtttacaaaaccatactgtgaataccagatgccaatgagagacctgcctgctttagaggaggactgatgtgaggacaccctgaacctgacagtagaagaataacagggacagagagagcacggggacagcaatcagaatgggagatgaattcttagggaagcataatatttgcctaggactaaaaaaagaaaatcgacattaaaataataaagcaattggcagtgagagcaacagataatcataagtcaacgatcttttttacacacacagagtagaccagtctagatgtctaatggcagttatgacatcttaggcattctgcatagatgaaaaatcatgctgaaatttgaaaaaatgatccatgtaatactggtgtgaataactggtttcagatctacattatacagcctatatgatattagcatgttcattccccagatttagataggtagttccatcagccaatcctttaacaagattctgttatattatatgtgtgtgtgtgtgtgtgtgtgtatatatatatatatatatatatatatatatatatatatatatatatatatgttaggtgcatagaatagtattcagatgagataaaaatcatgcttacttcatctaagtacagtgtgaggaaaccatcacaatggcaagggccagggcagtaataaattacagtggaaaacaacattccatctaaaattcagtatacattctgcaaaatttccattagttaatctggctgaatgagctggaagaaagtagggcactgaattaactttttagtaggcagaggagtttctacagcatgtatttcttcaaatcagagagagcacacactgccaaacaagcacatgtggaaatcatgggaaaaaaaggctcaactgcaagtcatggggcttaaattctaatcctagtgcctgtaactgcatgtcaggagtaagtcacttcctttcttttgttttgagatggagtctcactttgtcaccagtctggagtgcagtggcgcgatcttcgctcactgcaacctccgccttccaggttcaagcgattctcctgcctccgcctctcaagtagctgggactacaggcatgcgccaccacgcccggctaatttttgtattttagtagagacagggtttcaccatgttgggcaggatggtctctatctcttgacctcgtgatctgcctgcctcggccttcccaagcattgggattacaggcgtgtgccacgcatccagccaagtcacttcctttcttagagctggcatctgtaaatgcagcggggatcactaaagactttttagttctgagtccatgacaagatgtgcagtcaaaacactagctagaagttgtggcagagcagccgccatccttatttttgcctccttgtgtcaaagggaaatggatttttctttatttctcagacattcttgccattgcccatgtcccaatactctaacacgaaagagaaaaatagcccaatacgaaatataaaagctgattttaatttcagttgcttataactcaatcctgatgattctcaagggctgctatagtatagagtttttgtacacagagcaaatgaatgcttattccaaataggaactggttttatgagtgtgttctatttacacattttcaaaaactagttgtaaaaacgcacacatgtcttgggattagccaataacacatcccatgtgccaaaatatcctgaatgcattttgtttgaaaatcaaatatcactcctaaggaataagcaatatagtcttctcataatacctgttaatggtatctcttttaaaaatcactattccttaatatttgaaccataatgaatgataagtctaatttcaaagccacaggcttggtcactgaaacagtcacagtttttatgaaatttcaaaacaaaatcagtggaatgcacttttatctgtattttgcagaaacaaatgcttgaattgagaaaagtgtgtaggacgtcaggactgatgtttgcaacttttgaataatctttacagcaaagtatcattttaaaaatcctagtttataaaagcacatgtatttatcaatttttatttttaaaatctctgtgtgtatatgttggtgtatgagttttagtaactaaaataatctgaaaataagaattttagattttagaatacctaaaatctaatacacaagctttccatgaacctactggatagagatcatctttctcaaaattagtttggaaactagatatgggtaaatttgttaaataagatgtattaaaacattttttctgtttgctgttttaaaaccagcacagtctttcataaacaatttgattgtaattttaaataccacaattaaaattataactactgcctaacaataacaatgaggcaggttcagaatccataatgagtaaattcagatgagttatttaaagtattaacaactcccctcaaaaatccccccctcttttcttcaccattctgcttgctaatttcactattttttgtaattagccagaatttaaacatcagatgtttttaaagaattaaaatcaggctgggcatggtggctcacacctgtaatcccagcattttgggaggccaaactgagaggattgcttgagactaggagttcgagaccagcctggacatcatagtgagactccatctctacaaaaagtttcttaaaaaattagcagggcatggtggtgcacacctgtggtcccaggtacttgggaggctgaggtgggagaattgcttgagcccaggaatttgaggttgccattagccatgatcatgccactgcactgggtgacagagtaagaccccctctttaaaaaacaaaaattaaaaaagaattaaaatcaattagcctccaagaaaatatggtttcataaggttcttttaataaagtacatagtgagacagctttatttccagaattcaaataaattctaggggaggtgggggactgggacaggctggtcaatgggtacaaaattacacttaggcaggaagaataagttttggtgctctattacacagtagggtgactatagcaaataacaatgtagtgtatatttcaggatagctagaagaggagattttgaatgccgttaccgcaaagacatgataaatgtttaaagtgatggatacggtaattgccctgatttgttcattatattatatatacatgcattgaaacatcacatcataccttataaatatatacaactataaggtgccaattataaataggaaaataaattctagatgctgtaggtgatattaacaagaagaaatgtctggagcctcagtggatcagtaatcttggtggacaacacacacatgccccctggtgggaagagtactgcattatatggggcaatggttatgaggctggcctttgagccagactgccctggccccgttgcatcttagcagttctttagtcttcaaaattcaaatttttaccattttcattatgtaataagctttcctataaatgtgatcatcattcttagaacacgtatcttcagactggcttctctcctaaattcctgtatggtattctgaacagcctttgtgacatctccacgtgaatattgaataaacatctcaaattcatcatgtcaaaattgaattgttggctttcatctgaaacccactcttctcgcagttcttctcacctgagttaatatcagtgactttcattccactgctcggaccaaaaagcttggatcgtctgatgtctttctcccattcaccgactccagtccagaagcaccttctgatgatcctgttttgctgtatgttcttagaatctgccctcttatcagccacccacatccaccacctccaccaccccagtccaacctcatatcatcctgtggctgagtcactgcaacaacattcaaactaatttcattcacactttgccctttgctatgatgattatcttaaaacatatattagatcaagtcgctcctgtgcaagccctcaacaatttcccctatttctcaggatcgaaataaaattccttgtcataggctttacaagatcttatatgatctggccaccccagttacttctctgtcttcctttcctatttccttgcccatctttacatatcctcctctagttcacagacctccttgttgctcctcaaacataccaagcatgcgcaggccttaggctttgctaggctctctgcctggaatgctcagaacccttcctccagagagcagaacaccccacttccttccttcagttggattctagccaaagccactacatcagagacaccagccctgactacactggtgtagaagaccgcgtatcttttagttggctttcataaaaaccatttttatttagtactcatcaccacttaccatataacatatttacctatttttttattgattattatcttgtctagtgaatattttaagctctaggtaagtatggacatttttgtctgtttgcttggttggttttagtggtttgtttgcttgatctactctctgacagtgacttaatttctgagatattgcaaccaactaaaaaatatgagagcggaaatggataaaaggatcttacattagttcatagcacaaattcttagaaataaaataggggagccaaaagacgcacatattttttaagtgttgctattttatttatttatttatttttttgagacggagtctgtgttgcccaggctggagtgcattggcgtgatctgggctcattgcaaccacccctccctggttcaagtgattctctggcctcagcctcctgagtagctaggattacaggcacgtgccaccaagcctggctaatttttataattttagtagagactgggtttcaccatgttggccaggctggtctcaaactcctgacctcaggtgatccgcctgcctcagtctcccaaagtgctgggattacaggcattagccaccatgcccaggctatgtatgtctatgttttttaaacgtaatattgttccatctccagatggcatctggagatggcattattagcaataatacatatatagtataacatacatatatattatatatatataatttaaattctcaccaaaagggtataaatgtgttggtatccctgtaaagtagttaaccacttggaattattatttattttctcgttcttcatttgctgggaagaaatggcattttgctttaatttgacttaactggagttatattgaattttagctaaaatgcacagtcttttaatacacagtatgagtgaaagaaaagacatttcaagttgacagggaaggtttcacaaaagggtaggttagactaggaatggaaggattttagactgttggtcaagagggaggtccttcaatttctccccagttctcctaaaaatgctctcttttcttattttctcacctttcaattttgatttgtttcctaggcttatcttatgtaattaattaataaaaatgcattccctttttatttttcaaattctttgctccattatttactcataccaggttttattaatttaccctattagacttcatttcttcagccattcacctgtcatccatccacccatctgctatccactcatccaccatccattcacccatctgctgtccatctaacagataattattcactgtctgcttggttttaggtgcttaactacaagccacagatataaaagtgaaggtgacactctccctctctctaccctcaagagactcacagtgacatggagtatcctgtgctttaaaaagccaaggatgggccgggtgtggtggctcacgcctgtaatcccagcattttgggaggccaaggtgggcagatcacccgaggtcaggagtttgagatgagcctggccaacatggtgaaaccccatctgtactaaaaatacaaaaattagcagggcgtggtggtgcatgcctgtagtaccagctgctcgggaggctggggcaggagaatggcttgaacccaggagacggaggttgcagtgagccaagatagggccactgcactccagactgggtgacagaacaagactctgactcaaaaaaaaaaaaaaaaaaaagccaacgatgacttctggttttaactgagacatttaaagagcttagaagctgtcactctcatcctttcgacaaaagaaaaccaaacaagctgaaaatcaactatttttcctggaccattcagagaagtaaagttgtaggacaaacctccattccaaaatctgcatagacaggctcatccagagacatgaccaagatctacttacttggagcagaagcttttggatccataaactgacagaaacatgaaaatagctcttctgacaaagaacttgagactcagtgtgaactagcttgacaataaggaactcgaggggctcatagtgttggtggggaatggagcacatgccttcatgagctacacttccagaaatcccaccagattctcatggtgaagatccaagaaagatccctcatggctctggcagaagagggaaaagtaatcattgcgaaaaatgcccagagccctctctataacaaaggcctctaccccaaaggaaagacattgtcagacattattctcaccagggaaagggcatttctccaactacagtcccctctagactttgtctctcaccgaagggaggaataaaagcaaacaacattaacaggggcagagcttctacaaaatagtttgggaaagctacagctgggaaaggaagatagtggtgggagacaggggatctatacttctggagaacacttgcaaaggtcacagctccaagggacagactctgaaatgctgagatttcattgaaatattatataattctctcattccctaacaactatccaccatacctataggctatggtataatatcagattacagctgaaagagctgttaagacacaaacattctctgaggtgaaatacttagaggagctcaaagtcacagaagaataaaaataaaagcactagaggaatttgaagcttctgtcatttataaccacagcaaacattaagcacggtccaagtactaaaccataaattagcacactaaaggcctgagttcccattacctaatacaagatgtgcagctttctttcctttctctctctcttttttttttttgagatgggagtttcactttgttgtccagctggagtgtagtagtgtgatcatggctcattgcagcctcgacctcccaggctcaagcaatcctcccaactcagccttccaagtagctgagaccacaggcacgtgcaaccacaccgggctaattttttttatttgcggagatggggtctcaccacattgcccagtctggtcttgaactcctgggcttaagctatctgcctgccttggcctaccaaagtgctgggattataggcatgagccaccctacccagccatgttcagctttgaatgtaaaattacaaggcaggcaaaaaagtaagaaaaacacagtgtgaagaggcaaaacaacaatgagaaccaaattcgaatatgacacagaaattggaattatcagacaggaagtttaaattgtaattaatatgttagggactctaatagaaaaagtgcaaaacatggaagagtagatgaataatgtaagcagaaagattctaagaaagatattcgaagaaagaatcaaaatgaaatgttagaaataatactaaaaaagaaataaagaatatcttgctgggctcattagcaggctacacaactctaaggaaagaatcagtgagcttgaagattaaccaacagaaacctcaaaaactgaaattcgaagaaaaaaataacaaggaaaacaaaaagaacaacaataacaaaagcatccaaaaactgtgggacaatatctaaaagtgtagcataacataattggaataccaggaggagagcaaagacagtgcagcagaagaaatattgaaatgataatggctgaagactctccaaaattaataacaaatgccacactacactcagagagaaagaaaagtaaataacaaaaaaatctaaatctacacatatcttattctaactgcagaaaatcaaagaaaataatcttgaaaaaagcgagaaaaatatccttacctatagagaaacaaaaatatgaatgacagtgcgcttctcatcagaaactatgtgggcaaaaaagagaatacagtgaaatatgtaaagtgttgaaggaagaaaacccactaacctagaattttacatcaagtgaaattacccttcaaaagtagaggagaaataaatattttctcagacaaacaactgaaagaatacattactagtgggcttgccttgccagaaaggttacaaagaagttcttcacagagaacaaataataatatagaccagaaacttctacatacataaagaaagaaagaacatcagggaagaaataaaggtaaaacaaaatctcttatttttcttattcttagtttatctaaaatataactatttgtttaaaataatagtaacagtattaggtgattataaaatatggataagtgaaatgaacaacagcagtgtcgtaaaggaagaaagggatgaattgggaatattctgttacaaggtaccttcatggtatatgaaacagtatagtgtaatttgaacatggagttagattaattaaaatgtatatcgtaaactctagaacagctgctaaaaactttaacaaataagtacaattgatatgctaagagaagagacaaaatggaattatttaaactgctcaattaaaaccagagttggctgaaaaagaaggggggaaaagacacaaatgaacaaatgcaatggagaaaatgcatgttttgtccaaatgcattgcaatacaatgaacaaaatacatacaaatatgtaagaagaatccacatatatcaataatcaccttaaatataatggtctaaatacaccaactaaaaagcagagattatctaagtggattacaaggaaaaagacctgactatacatgtatataataaactaattttaaatataaagactcatatatgttaaaaggggggaaaagagataccatgttcacactaatcaaaatcttttgaaatagtatctaatacagaagcaatattaagtttaggcaaggcagacttcataacaagcaagtttatcagggataatggaaagcattatctaaagagatcaattcttcaacaacaataaattgattatgaagatcacttttctattacaatcctaaatgtgtaagcacttaacaacagaatgttaaaatacataaggcaaaactagagagaactgaaaggaaaaataaactcattattacagttacaaacttcaacaccactttttcattaattgacagaccaaataagcagcagaaaatcaagcagtcagaatatagttgacctgaaaagtactatcaatatataaattgatagtatatcaatgatataaattgacatttatataatgttctatccaacaacagcagagtaaattattctaaagcatacatgaaatattcatcaagatcaaacacatcttgtgtcataaaatagatcttaaatctaaaagaacagaaatcatacaaagtatattctcagatgcaaaggaattaaactagaaatcaataaaagaaaggtagttggaaagtctccaactatttggaaattaaacaacataatctttagtaacccataggtcaaagaaaatgtctaaagagaaactgaaaattatttttaactaaattaatatgtaaatgcagttgatcaaaacaggtggactgcagcaaaggcagtggttaaagggaattcatatcattattaagcattaatgcatttattacaagaaagatacaaaattaataacctaagattatacgctagcaatattagaacctagagaaagaagagcaatttaaacctagagtaatcagaacaaaagaaataataaaattacatcagaaatcaataaaattgagaacaggaaaacaacagagaaaaatcaacaaaattaaaagctggttcttgtaaaaggtcaacaaaattgacaaatctctgcccaggcaaaccgtgtgaaaaagaaagaagactcaaattaccaatatcagaaatcagagagtggtcatcattaaggatccatagaattaaaagataataaaggaacactatgagcaatactatgcccacaaatttgataacttagataaaaaatgaacaaattacttcaaagacacaaaccatcaaaacttgcataagatgaaatgggtagcctgaatagctctatttctagtaaattattgattgaatcaataattaataacttccccctcaaaaaagcaatgggcctagataattttactggtgaattctatcaaacatttagggaagagatgattccatttctccacaatgtctaccagaaaattaaagcacaggtatcccttcctagctaattgtaaagccagcattaacttaatactaaagtcagataaatacaggaaagaaaaacgacagaccattttctcttattgacatagaaacaaaagtccttaacatattatcaaatggaatttaacagttaataaaaagaattatacaccacaaccaaagggacttattgcacatatgcaagcctgatacagcatttgaaaatcaattaatgtaattcaccataggacaagctaaaggtgaaaacttatacgatcatatcaatttgtgacaagaaatcattagacagaatccaaaacttatccatgtaaaagaaaaaaaaactcttagcaatctaggatcagaggagaactttctcaacttgatgaaaacatctacaaaaatactacagctaacatcattactaatggtagaaactggacagtttctctctaacatcagaaataaggcaagagtgtcctctttcacacttcatttcaacattgtattggaaactctagctagttcaataaggcaaagaaaaaatgttatacacattggaaaagaagaaatagttaaaattgcctttgtttgcagatgattataattgtctacgtagaaaatcccaaagaatctacaaaaacactcctgaaatttaaaaggtagaatatcaagtttataggatacaagctccataaataaaagttaattgctctcttatttaccaaaaatcaacaattggaacttgaatttaacaatgccattcacaatagcagcaaaattggaaatagtgataaatctaacaaaatatatacaaaatctgtgagaaaaactacataacactaattaaagaaataaaagatttaaaaatggagagagtccatgttcatggactggaatgctcaatgttttaaagatgccaattcatcacaactgaaaaactgaactaaagattcaatgctataccagtcaaaatcacagaaagctattttaaagatactgaaaaaatgactgtggagtgcatataaaaggaaaaagatccagaataaccgacataataatgaaggataaaaacaaagttggctttaggaggccgaggcgggcggatcacaaggtcaggagatctagaccatcctggttaacacggtgaaaccctgtctctactaaaaatacaaaaaattagccagacatggtggtgggcgcctgtagtctcagctacttgggagtctgtggcaggagaatggcatgaacctgggaggcggagcttgcagtgagccgagatcatgccactgcactccagcctgggcggcagagcaagactctgtctcaaaaaaaaaaaaaaaaaaaaaaaaaaaaaaaaccgatttggaatatccacactgatttcaaaacttagtttcaggctgtagtaatcaagacagtgagtactggaaaaagaacagagaaatatataagtaaaacagaaaagagagtccaggtatagacccacagagtcaattgattttagacaaaggagcagaaacaattcagtagaaaaagaatagtgtttttcatccttatttgttgttttaacacaacacaaccaattgttatgtaaaaaagaaaggcctgacactacacgcaggtcttattagttttcacaataattaactcaaattgtattatagacctaaatgcaaaatgcaaaatcagaaacctactagaagaaaacataggagggaatctgtctgaacttgtagcccacgatgggttgtcaggtatagcactaaaatcactagtgcaacatgaccttacataccaggatgagtttgtagagatagcactaaaatttagaattaccagtattacaaaatgaacctttatacatacgtatttcattcttaccagaacagtggaaacacttgcacaaagctaacgcaattgtcttcatttcacttgatgcacacactctctacctttggctccctgatgagtaagcaagggctgggaacaaaagcaacaatgggttgccctatctgcctttcctgtggaagagaagcaggagccaactccaagagttcccaatggccaaagataaaaccatttcagaaaaaaaaaaattgaattaagtaattttatattttgagattatatcccaaagtaccaaaaacaaaaaacaaaaaaacaaaaaaaaaacccactatgggttcatgctgatgtaaataaataattgaataaataaatagaaacatcttccctgccaagaattccaaataatttacgtagatactttagcctgaatgaggtggagcataacactccactccttcagtgggggccacatttagtacatttagtaactgtttttccaaaaagtatacaatgacaaagggaaaaatatgagtcactttacaatatattttacatcagcagtgatgtcatgtttatagtgtacacacttaaatgtatattattaactgaaagaagccactctaaaaagcctatggagtgtatgactccatttacatgacactctgaaaaaggtaaaaagagatggtaaaaggatccatggttttctgacgtgatgacaacagcactttccctttgtgattttcctcccccaaacccataacctcagactaatcaggagaaaaaaaaaaacgttaaacaaatcctaattcaggggcattttacaaaataaccaagtagtactcctcaaaacggttaaggccgtcaaaaacaagaaaagtttgagaaactgtcatagtctagaggaccagaagaggtgtgatggttgataataagtgtcaacttgattggattgaaggatgcaaagtattgttcctgcgtgcgtctgtgagggtgttgccagaggagattaacatttgaggcagtggactggcagaggcagaccaccctcaatctgggtgggcaccatccaatcggctgctagtgctgctaggaaaagcaggtggaagaaggtggaagagcagacttgctgagtcttccggcctccatctttctcccacgctggatgcttcctgccctcgaacctcagactccaggttcttcagcttttggactcttggacttacaccagtgctttgccaggggctctcaggtcttcggccacacactgaaggctgcactgtcagcttccctccttttgaggctttgtgactccgactgagccactactggcttccttgctcctcaccttgcagatggcctatcatgggacttcaccttgtgaccgtgtgagtcaattctccttaataaactccccttcacatatacatctttctattagtcctgtccctctagagaaccctggctaatacaagaggcatgacaactaaatctaatgtgatgtcttggatggaaccctgggacaggaaaaataaaggaaatcagaaagtattgacttcagttaatattaatgtatgttaacttctttaatattaactgacttagctaatattaaccagtaccaatattggttcattggttgtgacaagtatatcgtactaatgtaagatgtccaataatgagggaaactggggggtgggatatatagaaactttttgtactattttgtgatttttctgtaaatctaaacctattctaaaataagattttttaagagcaaattacaattaaaaaatcactctactgcataacctgtagtgaaggtctgtgcagcatctcaaagaaacacataggatgaagaagccagagacgattttacagacccagtgacccttcttctcacggagacttgaagaattagtaggagtccaatgaggaagaaggcactgaaaggcagaagaaggcacaaaaaggcccctaggcatgtggtggctgggcacccctgataaagtgcagttcatctggcagaactacaagttgagaaagcctcaggccggagaaggatgcaaggctgtgtccttcctgaaagtccttattggcatttgttcctctgagaaggcgaaatctttgcacaggtttaagtgggaaagtggcaaaacaataagagcctcattcatttctgctgtgttccagatacgatgtcagatttttcagcttcgttatctttgatcattacaaaggatccttgtatttacaaggttagagtttgttctttaggagatcattctccaaatctggagactagattgaaaggtagcaaggctggaggctctttgcggaagtaactgacacatcttttcatcacttcttgtctgttggcttttgtcagtgtgcttgaaaataatttcagctgtttcatgtcatggaattagatatgctttgattacagtttctgctttcttgccttcacccaactcactccttagtgatgctctgcaggacgacttttattctttctctataaagaaactgctcctctgaactcaccctgcccaagccctgcctttacattatgtatacgagttcttccagtcaaactggatcacttagtgacttggagcaggtggcactctcctccgtacctctcctttaacatttatgtatatgtcaaaaagcttccttcttgcttttcttcactgggtataattctgtccaattccctgggtccacccaaatacagccctccctcatgagaccttttctgacctcctagagcaatctatccctccaatgagccctaaatgcctgatatcttttactgtagctaattgtgtgctgttattagcctttcctatacttttcataaagatcttgaaagacaggcaggcacgctgcttaaactctgtttgcctggccgtgcacactttacacctggtataagcagaacgtatcatttgaactgaaaataaagtaagaaaaagtaaatttaactttaaaataaaacacttatttcagagtggttctttgatacttataataaatgctcactttgctttgatactggatatgactaaagtttactttatttggacggatatattacctttgactgctgaattaaaagaatcaatgccttgatttaagctgtgcagctaacagtagctctgagaataaacaagaggaaaatacagccatgtatctcatgcatgagagatgcatcttcggtgatttcatcattgtgcgaacttcatggagtatacttacacaaacctagatggcacagcctactacacacctagactatatggtatagcctattgctccaaggctacaaagctgtgcagcatgtgactgtaccgaatactgtaggcaactgtaacacaatggtatttgcatatctcaacatatctaaacatagaaaatgcaatgcattactctataccattatgatagctacagtatcactaggcactaggaaactttcagctccattataatctcatgggaccattgtcatacatgctgtcctttgctgaccgaaacgttgttatgggatatatgactatatataatttttatgtaagaattttacatttattttttattttaaaaaggacacttcaccataacatcttgataatttattaaattgcaaatacataagatgataaaaaatttcaaatgtcatcttctctatttttaattaatgcctagtgagagcataaacattatttcaacctaccagtccatattttaaaatacaagttcacgcttaaatacatttggagtgaaaaatgtctaaaacatcctaggcatggtggctcacgcctgtaatcccagcactttgggaggctgaggtgggtggttcacctgaggtcaggagtttgagaccagcctggccaacatggtgaaacctcatctctactaaaaatacaaaaattagccaggtgtggtggcgtgtgcctgcagtcccagcctctatggaggctgtggcttgagcctgggaggtgaagattgcagtgagccgagatcacatcacagccctcctgcctgggtgaaagagtgagtgagactccatcccccaacaccaaaaaaaaaaaagtctaaaatattgatttgcttttcttcttcttcctcttcttcttctttttttttttttttttgttgttgttgttgttggggttttttttgagacagggtcttgctttgtcacccaggctggagttcagtggtacaatcatggctcacttcagtctcaacctcctgggctcaagccatcctctcacctcagcctcccaagtagctgggtctacaggggcacagcaccatgcccagctaatttttgtattttttgtagacatagggtttcaccatgtcacaggctggtcttgaagtcctgagctcaagtgatcttcccgcctcagccttccaaagtgctaggattacaggcgtgagccactgtgcctgggctgttctttttttttttttttttttttcccagaagtctttgaatccaactttaaaagccaagtgaaaacctcagaaaacaaatgaagcctgagatgagactcatggaacttgattccttacccgacctatttagaagacattccttaacctatgtacagtcacttaattctgcccatgaaaagcaatgttgcatttcctcacagctgaaaatacttttaaaagaaagtaactataataaattctgaaagtggaaacttaatttataaaagcaatgaagcttgagacctaactttgtgggaaaacaatgcaggtatcttttttcacattaaaaatgttactaatgaactttagtctgattacaaagctatctgaaggaaatagcatgccaagtgcaattatgaatataggtaagttggataccagaatctgttttaattaagtaaaattatgaaagtgggataaaaggacaaaagctctgaaaaacaaatggttgattccagaaatttttattcagataatgaataagacagctaattatttggatcatttagttattgattaaaatggtaaaagtaataaaaattatctgtaaagtaatgtatataaatatagccaattagaaaaaaaaagagcaaagttgctggaagaaataatggcatcaaaaaaattaaaatatcaccatttccttcagctaaagattatgcaatggtagaaaaacatactataacagagaaatgagtttcatatcaatattttacttccttttttaatctcctctgccatctcctcctcatcagataatccaaagtgatgtcatgcaggggtgacagtttgtacatatggatgaataacatcaatgtatccaccttatataaaataatctattatcagggagctcaatttagctttattggggtctttagaaatttactattaatatgtgcatgtttattttcacttacttcaaatgaaaattgctttttcaaactattgagatgccaaaatataccagatatagaccagaaatgtgtagcaatttgctacctattgtcatactctagctaactttaaatttctaacaacccctgtgaggtctacaatggcaatgcgcaatggggaatgcaaaatggcttaaatggcatttggcattgaactggtacctttctgaggacaacagtttatagggggaagaacagtttcaaggacattaagaggcagcagagagttgcaaattcagaagttttatcaacattgattctgagattccacattctatctttaattgatgattatattgtccaaaacttttcactttatgcaagctcagagagaaaaagagagaagaaagtgagtaagggagggaagaaggcagagaggaaggaagggaggaaggaaaataaaaagagagagaagaaagagagagagagaagaaaagaatctgcccttaattttgctaccttcctaagtgcgaccttattgcaatttgctccccttccttttgagttcatgcctcatgaaagagtattacacacgtatgttccttactttcaactcccaaccccttccttagctcaccgtacttgtcttcttccggcagaagtctactgaatctgttctctcaaaggtcaccaatgacttcctagtagaaaagttctaccacttccccactctctcccagtcttctctgcttaagctctggtgaatctcccttcctggagccctctatgtggctgctgtcacgctctgtctactctgctatctttctctccggctcctgacctagttttccctaccttctgactcctgctctctatggttaaaagtctcttaaaaatctatctctgctgtagcttcccctttcctttgtttctctctatattctttcttccttggcaagctcatctaatttaaaaggtctgcttaccaaatgtgtacctcagtcatcatttattcaatgtaggagaacaaaacccactagacaaggtgccagctctgtctataggaagtcagtagtctatttaataggtgaaactggcaaatcaacagacacttaactacacagtctaataatttcaacagggaaaaaatgcagtgtgttctggaaaaacattaaaggaagatccaatctaatcttgggagctcagggagatttcctggaggagttgatatttaattcaagttctaagtaaaaagacaggagtatgaagcaagagaaggttccaagcaaagaaagcagcatatgcaaattattgtgattagggatataatgtcatttgagaaaccactatcagttgggtggcttgaagacacagcatgggttgaaaagtgatctgagcagatgcaatgatataaatatggctatatcaaaaagggttttaaatataagctaaaacgcttgtttgaacattatcctgaggaaaatggggggatctattagttattgaacttcagaagagacatgattagatctgagttttggaaagatcattatagatgcagtgaaatgaattgactggtgtgggaaaagaggaaaaggaatatgaggtagaaaacagtggcagttcctagtgagatgtgttgatggttggaatgaggagtgagatagtgggagtagagagaggtggacagatctgatatttaggaggcaaagtctgcacagatttggggatagaagaatttcgtccatttagatttgttcagtctatgagatgcccatgaaacgtccaagtagagatctatagcagacaagacagttggccaggagctcagaagagagtccagaggtatatttgtagtggttatcataccaacaatgggcaaaataaggaagtgcataaactgtgaagagccaagaaataagaaatctcatgcctgggtctccaaaaccctgaaagttaagaggcaaatagagaaatctgtgaaaggtactaagatggagggtgatgaagttatggcacaacaaagaagagagtaatggaagctaaaaaggagtgaaaaatgctgcagtgaggccaaattgaggactgagaagtaatcattgaattttgcaacaagaaaaatatcagtgatcacagcaaataaggtttcagtgtataagtgggggatacacaccagattccagtgaactgagaaataaacttgagagagaggaattaagagacagtaaatgcagctgagtttgtgaaaataggagagacataggagaatagctagcgtggaccatgaatcaatgtaagagtgtattatgatgggagagaactgtggtgagtaagcctatacagatatggctggttaagatataaaagtgaaatataagaatgaaatgttgggcatggtggcccacgcctgtaatcccagcactttgggaggccgaagcgggtggatcacttgaagccaggagtttggggctgcagtgagctgtgattgtgccactgtacttcagcctaggttatagagtgagaccctgtctcaaaatgaaaataaaaataaaaagggatgaaacaacactgaggtggtgagagaggatggggtaagaagcacagggaagctcaacacagacagcaagagaagcaagaatgggtgcacacagagtcaaagtgtatttgtaaagcagagcgagttaaaacattagagacatttcctccttgctttctatttaccctgaaagattatggtctgatattgagaatgactgagaatgtagcatgccagtagaggaagtggagaaagctttgaataatcatcccactaaataggagatcgatccgattacagaaaggattgccaggaagtcaggaaggcctgattgaggttgggaaccatgacatcttggtagcaataatttataggattgagtgacttttcaacagcgacgtgcagaatttcagatagacacgggaatacaacaagattgatccaggatcagaaactctcttggtggatgcactgggaaaccaagactggaggaagttgagagcatttgtgagttgtagtgtctgatcgtttttgctgttggtgtaatgatttctttaatgtcactcttgcctgtaagaggggcagtgatgtgtttattaatcatcactgtacctccagtgcaaggatggggacattttgtgtgtgcattaacaatttattaaacgcatcacagtcctacctgcaaacctgatttatttggttactattttatcaccctatcatattgcagagattttttaccttgtgaccaaccaaaagtgtattttattcgaacttaaggcaaaacattttgacatcagagatgaagagacatcaaatctattttttaaagaggtcatgaaaagaacatccctttgtctttcccgacactccatttatattacatacattttcctttcggacacttgttctgttctgttctcttgggtaagtgtcatgtgtggtttaaactcagggctcttccttctttgtggaactttatcagatacgttgatggtgactaattagatgtttcaacttcaaacaagttaatgtttcaacttcaagttgaaaagattattgcattgaactgtactctttacctttgcttctctcaagaaaatgtttatggccctattttcttattctcatatgtttgcttcttaactgtttaatgatgtcactgcctctcaatcaactctctcctaggcctctactgtcctcattaattgcagaatataattccacagaagcccctttatgatgctggagaattttcacataatttgtatgatagagtctaagtaatacctatgtttctgtcccactctttactttgaaattttgcacctccctgccagtttgcttgcatctttttctctgactttgcatgcttgaaatcgattatttggtaaaatgcctcaccttccaggtacagaagtgtccccaaccacacaacattatttgacttttagtagtagttccttaagacatgtccccagtatttccttacagcaagtgctcacgtaaagcagacgaatatttgacaaaatctgcaggagacacaggtggagagtgaacgaggctcacaagtggctgccatcagcccttccttcccggcagcagtgtggaggggccgtcagctgccagacacttcacactccactgtttgctcccgtttctcttgtaaagggctgggtgggacagcaggggtgtgatgacatgattcccagtgacagaaatcttggctcctgttggctctaagctggacagacaagaaactggataaaaattcttttaataatttgtttccgtttacagtaccacgtcagtgaccacaaatttattaggctgctcttggacatctgttagtaaatcgggcacattcatcaaatgtgaggccccagatgggagctggaaagcattaataaaatgcagccaatgttcacgaaaaggcaaggcagtggaaatttacctattgtagagggaggaggtgctctctgtgcttaatagctcttcgtcgtatacccgactgagcagaaatatctcagtggagcaattctgggatttatgtgatgcaaccacctaccatctttgtcttatctcttacttttcacaggcatgaacctgtcattctagaaacactaacctactcattctccctaaactatataaaaaaaaagtctggatatgctatttttctaagctggaagtaaatgatccgaccttgaattgtgattaaaaaaagattatttgcaggatgtcatgacactttacaatggcttaaatttttgaaaaacttaggaaaaaaaaatcaaagtataaccgaaagcagttgtttcagttaatatgacattattttaggtttagagataaatttccagcagaagaatttgtctctttatgatttgtatgaattcttgctatggccttgctgttcctctgcttgggttttctctttatgatttgtacgaattcttgttatggccttgctgttcctttgcttgagttttccagaacgccacaccatttcagtccacaaataatggtttgtttctaagaggagctactatttgctcataaaactcattttctatggaataaaagcagcctgtttaggctgattcagaacctgtagaacattttcctgtagttgggcaaccgctctccttgcttttacttagagaaaaaattgattaatcgaaacctatggataatagctttgggaagtttcattttctatttgtaactaaacattttctatgtcatgaagggtcaagggaacctagggtttttcactttaaggtaaacctccagttacagcttaaactatgaacgtggaaatgtctcctatattgttaagtaaaatatgcaagataaaacaatctatttttttaatgttaatattctctgttaagtgcattcaattcaacaatgtttactggttacccaacatgtgtgaaacactatgtaggggttagggacaacacaaagaacaaagtccttctacttataaagctcatattctagtgaatatgtggctcagacttcgggaaatgtcctaagtcagaccatgatgtgtcagtgtgggacagcccatgcccctgtcaacaggggtggtgtttgtcatgtcaagatatccttggaagtggtcaatcttaaattgttcttgaggtcaatctgacagtcggatatgagactttagaaagcgtggctaagagtaaaatgaagaaactgtttactctttttcttccactaggagtcacttgagcccagactctgggcctaaatatacctacaagattttagtgatattggccactgtcctgagacatgagaagagcctcagagaagtagcttctaaaagacacaaggatagatctgggctgggaaagggtcgtagttaccctgtgtgctgtgtttttcttcttctatccctggagctcaacaaaaccttgtgaaaagttagagtctgagagatcacggaggaagtctgtgaagtggtacaggctgcgtaataccccgggcacaagcagtgcccttggctagggtcaaagtgattgtgccaagaagtgggggggggggggaaaaggctgtagcaagagtatgggcttcacaggccgctgagggcaaagagacatgagatactggttcacgagaggcccgagaaaatgaccacatatggggagtaggaaagacactgagtggggctcgttccaatgataaagccagagtgggctcaggccttcaaagaagactggacagacagatgtgctagaattttagctatggctatctcagggagcttttcgtgagtgctttttattttcttctttttatttttttcatgtttcccaaattcgaaattacaaaaagcaaattagagttattgcttttaaagaatccaaaatgttttaagaaaaatgtatacattataagtaactacatgtgacatttgactcctgtccctaggcaggggctgctgaaacatctaccaaccaatatccatatccaaacatccaatatccaaacaaccaatatccaatatcccaggaagacttggcagatcagttcgtgagggccaagggttcactgatggtgctgccaaaagtaagaataaagatggggtgcacccatcacttctcacacaggaagcccatgactatccacacatacccgtgttcatggatgaaccccagcagaggaagaggtgaatgtcatgtttgctaaaacaaatgagtaagcctcaggcctttgaaaaccagacactccctcttcctacgggcattcagtagaagcaaaatgctactgatgcctggcagatcccttccaaaatttggtttaaatcaaaacagcagttattacccgaaaataacacaaatcacaatctgagcatgtgcctcctgtgaaatggagataatcagaattcaacatggtgcgtataatgtactgtaatgggcctcaaagcccaggtattagtgagcacggcaggaagcaggaattctggataattcaagaggccccaatcacttgaatttaatataactgcaaaattaaaaaaaaaaagcattttagtctcattagacttgcagcctccctcacttaaaggggaattttcaaaatttgaaaatcgtatcagatgttacaattgaggtttttagactcattatttttaaaagggtgaccttttactgtacagcaggaacctgtcttgtgtggtttgagacaaatgacaatgaagagatggatatgttcctaggatcatatttaggctataaaacatctatcagtgcccttatcacactttttgtactgctgtagttagcatctcctatcattattagctgtgataaaagaaaatgtttcatgaaatatgacatagaaatagaataagcagcattgttctcaactgaaatacaggagggggaaaacctaactcattcctcatctgggaaataagaaataccgcattatctttaataaaagataaagggacctgacttttcagacagctcttacacaactatctatggccgcttctgggtaacagatataatcgtacatttctctgtcattttctgagtggctaccctgatgaataggcacatccttagatgatatcttctgctctaggccttattagctttatccagtgctttttacttttcttttcttttcttttcgtctattcttcttcccttcttcctttttaaggaaagttgcttatgtcttatttctttgccaaaggaaattcaagtcggcttataaaaggaacacatatatgcagaaaggaaagtgaggctctaaaaagaagaagaaagcaaagaggccagccagctactggaagaatcagacaatgccacaggacaattgtgcatcgtccatttggtctgtgtagccatgttcatttttgttttttctagtggacagtgtagaaatatcaagctctgctgtaataggagatgttcctgtgtgtaattaaacacatctccaaatgtccattgaaccctggcctcattatgtttgttcaagttctacaagataaaagacagaaattctaattagatttccagctgccttttgtattttccttaatagctgacaactctaataaacaatatatatttaaaaaaccaatcagataaaaatgagagaggtcacaaaactctgggactggcatttatagatgcatgtgctgtccagcaaaaaccaaaaatggaattaggacagacagatcacctgctggtctctaacaaacgtactgtgttggcatgatgccgacacaccaggtatgaatcccagctctgctcctcggttctgctgggagtctcaggggcttcatctgtgaagtgaaggtgacatccctcgcctggagcagtgttcatgcttttaaatcaaatgtatctgggtttgaatactggttatctctcctattcgcttcatgatctgagacttacatttttaaatatttcttcaaattttctttcttttctcttggagttcagaataatatatatcaagttctcaacatgatgttcagcacatagttgatgctcagtaaatgtgagctttcttgcccccttcctacttacaagaactaaatgaaaggacaacatccagcatggtacctggggagacccaattgattaatgctcatgtgtgatagttcttttttgctggaactgcaatatagtgatagaggtgggaagtgaaggcagccagaaactcaaacctgaaaaagcctttatcaacgggaaagatggtctgaaataatggcagacatcctgggggaaataccccctactttggcaatgaaaacttcaacgtatggccttcatgaagacctttcagtacattctaggtttggggactttgttgtgcagagcaattggataattatacaagtcaatggaaacaacagtcactcgttgcattacagaatgcagtatttaaatgcaaacgcaacaccaaaaacaaataaggtggggagtaaaagaaaagagtgtggctagcttctaggttaaataagacagttggtcccaacaggttggatgtgacgggactgcactggatggcactgatcactttgaatggcagacatcacagagcaacatgtgcagacttctcactttctgtacactagagcattcccaagaggcaagaggccaccaaaagagagattcttggtgttgttaaatgtgtaaaatatgccaggcagagtggcttacacctgtaatcccagcactttgggaggccatggcaggtggattactcgagatcaggagttcaagaccagcctggccaacatggtgaaaccccatctctactaaaatacaaaaattagcgtggtggtgtgcccttgtaatcccagctacacagggagctgagacaggagaattccttgaacccggggggcagaggttgcagtgagctgatattgcaccgctgcactccagcctgcatgatacagggagattccgtctcaaaacaaaataaaataaataaataaaataaaaataaatgtacaagataccataattttggtggctctgctgtagactgaatgtctgtatcacccccaaattcatacgggaggtgattaggtaatgagggcacagcccttatgaatggaattagtgcttttataaaagaggctccagagagctcgctctccccttctaccatgtgaggccacagcgagaagacagccatccatgaaccagaacgcagaccctcagcagacacaaaggccaccagcaccttgaccttggacttcccagtttcccaaactgtgagaaataaatctttctgttgtttgagccactcagtctattgcattctgttatagcaccctgaatgaacatagatagggtaccaacagaatataggcaaaaataaattcctcccttctaaagaaaagctcctaatacgctgaaatgaatacacaaagaaaactatagttcttgctcatctcacatgaaataagtagaactacatataagattccctgtgtacacaactaggaagctccagctgcagtagccagggtgtgggatgagagcaggtacccaaagatatgaggactttgtttgttccttaagcattatttataatataaaatgcacgtttgcaagatgaatgtttgggtaatatctattatcttgaaactaggtcaaatcaatcaatcttgttagatttatacttaatggctccaaactatgacttcttgcatattatcatcagagtgttaaatatatctcagaaacctagaatgtttttatatagtggtctactagcactggaacgataataaagcggtcatttttattgatctcctatggacatgacagcttgctcagtggacaataaaatatatattttgtaggtttataggtttgtaagggtcttaatggttatttgcaagggatattttaaatgcttctaccgcttccctctactgaagcaagattgttgtttgaaacaatttgaagagcatacagaaaagatctgtttttattgacctgtaatatacgagttgaaatacataggaaattgctctaacaaaatggagtatccagaatgcaacaggtaaatataacatcaaatccaaggaaatacattactttattccaaaagacattatgtaatgtacctttgggtcagttgggtccatgcctctcttatggttgcccgccatttatgcaaaagcagaatccaggtctgaaatagttgttcaaaaaggtgcaggacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcattagtgggtgcagcgcaccagcatggcacatgtatacatatgtaactaacctgcacaatgtgcacatgtaccctaaaacttaaagtataataaaaaaaaaaaaaacaaaaaaaaaaacccaaaaaggtgcaggagtctggtgcagtggcttatacctgtaatcccagcaccttgagaggccaaggcagggagatcccttgagaccagagtttgaggccagcctgggcaacaaccccgcctctcaaaaaaaaaaaaaaaaaaaaaattaaaatcaactaactaaatgaataaatatcagctgagtgtggtgatacatgcctgtggtcccagctattcaggaagcttaagcgggaggatcacctgggcctgggaggtcaagggtgcagcgggccgtgattgtgccactgcactccagcctggacaacaggagaaagactccaattaaaaaaaaaaaaaggagcaggcacacagggtacaggttgtacctactgtgcttttatttcaaggtttttgtgtgactttagatattcacaagtttctctcctgttaattttctggttgtaaattgatgagatatctgcctggctacttcatgatattgatatgataatcaagtaaaataatttaattaaggctgggggccatggctcacgcctgtattccagcgctttgggaggctgaggagggcagatcacctgaggtcaggagtttgagaccaacttggccaacatggtgaaaccctgtctctactaaaaatacaaaaattagcggggcgtggtggctaatcccagctactcaggaggctgaggcaggagaatcacttgaacccgggaggctgaggttacagtgagccgagatcacgccactgcactctagcctgggtgacagagcaagactgactctcaaagaaaaaaaaaaatctaattaaatgatttggaaaagcataaaacactttataagtccaaaacattatcaaagataacagagacattcttttttttggagatggagtctcgctctgttgcccaggctggagtgcagtggtgccatctcagctcactgcaagctccgccttctgggttcacgccattctcctgcctcagcctcctgagtagctgggactacaggggcccaccaccgcgcccggctaatttttttttctattttcagtagagacggggtttcaccgtggtctcgatctcctgaccttgtgatccatccgcctcggcctcccaaagtgctgggattacaggcgtgagccactgcgcccggccagagacattctttactttctcagttctgatgcaccctcatgttcctagggctgtaatttcattggcagtttaactaaattcgtggaatacaaaggccatttgtaatggagttttattaaattaattaacaagatttagagcactttcttcttcagaagacttgtggcaggcttgggaggcagatgacagactctataatggtgtgcacaatggattgatttaattcattcggtgataattaagttacttgatccagttgtttgatggtgtgtaagcaaaacatctggttgatttgcctgaatcttgattttcactggtatttttacaacagatattgcttctagaggaagaaactttgcaggtatttgtcattaagtttttatcctagataaattatatttatccttaatcttattcttctatctgcattttaagccattttgtttacactgggttttgtttagataaaaaacaattcatttaaaatttctttctgttcacgttctcacatccatttaagagagcacaaactgaatcatcagttaccataaatccgatgccacttcagtgaattcccatcagtcaaaaaaacaagtgattattgagaattgattgaccgtggcacttcatttgatggctggagagggtatgtgtcctctgccattatgttgcttagattcaactgaagtgatgagaccaacatacataaaataaaaaatataagataattaaactaagcaacagataaagtagtatcaaatggaaatattctttcagctcatggcaaagaaaagccaatgggggctgaattatggaagaaaggctcatggaataggctgtatttgaagactagtataaaagttgtatgcatttctaaaaaattcaattcagttaaatgtgcttgcacatattcagagttttaaaaatttggcctacataaaaatacaattaagattctggcccacttgcatgttgattcttttaagtatcacaaaacatggtattaaaagcacttttcagaggaagggaaaaaaaaaaaaccagagaaattaatttgcccaatgcctgtaaccagtaagtgcttgaaacaggattgaagctcaagcatgtctgcaaagctcatgaccctcttcaatgccaggattcctctcaaggaatgctgaaaactcaagaagcatgggatgatggagagaaggaaaaaagatggagcaaatagctgccactcaaagaacacagaaatgcggccgggtgcggtggctcacacctgtaatcccagcattttgggaggccgaggcaggcggatcatgaagtcaagagatcgagaccatcctggccaacatggtgaaaccccatctctactaaaaatataaaaattagctgggcgtgctggtgtgcgcctgtagtctcagctactcaggaggctgaggcaggagaatagcttgaacctgggaggcagaggttgcagcaagccaagatcatgccacttcactccagcctgggcaacagagcaagacttcgtctaaacaaacaaacaaacaaacaaacaaaaaaacacagaaatgcataacgttccttgatacccaggagtgacagcaagactcatttcaaatcttagcctactcattagattgagggtcttaaagtactattctccctggtcagcatcactagatgagcttagtcaggatgactcttacagtgagaggcagcaaggggcacaaatgagcaaggtcatgtcaaggaattactgatatctgtcaataattttgtgaaggatccagactttcttgaagctttttattttgataaatttgctcaaaatattatccataattaatatgacatgatattagtcataaagcatgtttactaagaaaacaataaatctgttctggaagataaattttgcaaactcaacccgaaggatagtaggacttatcacagaagggcaggtttaaaaggcagaggaaacacgaacgtggaagaacgttgccagtaatggccccaatttgctcacacagtcctgcgtctgtgcattgtatagtccttccttacagtggctttggacttgtccaggggatttgtcttagtggatgaggcaatagcaaatgtgacacaaacagaaactcacgttgtgcttgtaaccctgagaataccattgtaagaagccagtgctagaggctgaagggcaagagaatgaaaaatatttagctgacagcttaccaagtgccagatatgccaaaaatctaagggagcaatggagttactttcatgtaactgagagtaaaatagcaaaatagcacagggctttcagaagcacagcacagtttcctactttgaggtctgattagttgctgtgcccccagagtgagcctggctaaagcaaagagtgtcaatagctaggaaggggctctgccaatgggaacatgtaacaacatggaagcaatggggtggactgtcaacagaagacattagtggtggatgctatgcttcttaatgggtgctgtgatgaataactttatacgtcaacctggctaggacactgtaccctgatatttggccaaacaccagtctagatgttgttgtgaaggtatttttggatgagattaatatttgaattagtagactttgagtaaagcagattactcttcgtaatgtgggtgggcttcatcccatcagctgaaggccttaagagaaaagaaacagattttctccaaggaagagggaattctgccaccagacctccttaaacatgaattcatgcctaggtctccagcctgctgtcctgctctatgaatttcagaagtaccagttctcaaaattgtgtgagcaaattcctcaaaatctctatctatctatctatctatctatctatctatctatctatctatcatcgatctatcatctattatccatctatctatcatctatctatattttctatcatctacctatcatttatctatcatctatctatctaccatccatcatctatctgtctatctctttatcatctatcatccatctattatctttctatcatccatctatcatctatctatctatatatctatatcttctatcatctatcatttatctatcatctatcatttatctatcatctatcatttatctctatcatttatctatctatcatctatcatttatctatttatatctatccatcatctatcatctatctatccatctgtacacacacacacacacacacacacacacacacacacacacacacacacattgctttgtcctgtttctctggagaaccttgatgagtactaaatttcaacaatgtagacgtatgttcaccaaggactaaattcttccttccaatccccctgcccttatccaatgattgctgcacattaattttcctccctatgaaatcaaagtagccattttatttaatctttccgccacagtccaattgtaagactaatgcaatttattctgtgttttgcatttgcatgtgaattatatatatatacacacatatgtgtgtgtgtgtatttatataacacaaacacacacacgtaaatacatatcttttagattcttactgatatgattgaaaggtacaaatcaaaatataaacttttgacatgatggcaacatgaagtttaactatcaatgccacaaacaaataattgacacaaataaaaatctgcattggcactataaattagggcagcacgtggtctgaaagtctaaccaatattccatatataagaccagattgcaacattctcctgagacagcaccacagtactaagtagagaagactctaggagattactcataaaaccctcaatgccggagtggaaacagcagaatatatgtgagaaggcggcacaacactttgaatcccattcactgtagtacatcaacagtaccaaaaacagctgcagtggggctgcactaatcaaaccactgcaaatatggacagcttctctccccgcagtggagggcaaacaccacagaagaaatcagccatggccatgtcttggaggcagcttggcaatggacaatgttgaatataggacagaaatgtgttccaacgaagtaagtccatcacactcagtgacaacatgatatcatggtgacatcctgaggcaaggattactcccaggtccagctcgctccccaccatacttagtctgtcaaaaagctaacttattaatgcaaatttacattaaccagaatgccaactccagctgcaaagtggagacgatcccactgacatatacatacattaagtaatctaaggagaatccatccaccctgtcaataactgaagatcagttccatgtagagtccttcatgccagagacaaagtaaatgagaaaaattcacaaaacaaattcacaaatatttctaagacatgcaatggcataaagattataatagtatctatatatacctaaaatactcaacttaaatggcatgatgtaataaagcaatcaatgaaacataacttacaagagaattttatgcttagagtctatgattagaagagaactttctaaaggaaggtagaaatagagaactagaaaaaaataagaaaatgatgaaaagttaaacatgcgataatagatatattctctattagcatctgtaaagggctgaatcggcagtgaagagaattagaattaatgttatgatgtagaaacttaaaaacttaatctggaagagagaagggagagagaaagctaaaaaatgaattttaaaacagagaaaataataatcgagatgtagaaaagagtgaagcatatcagtaaatgttgtttcaaaacaggaaatgagaacgaataagcaggcatatagttagttacaattattataaaaaatacaaaaatacctacaattgccaatcaacattttctgaactattatgtaagagatgtggtaataactgctttacactgtatgtaatacttattaaaccctcaggaaagcactaagtagtagatgttattattatatgcattttataaatgtagaaaatgagcttaaataacaaaacagaaaaaaattttcttcaactaggaaaaacctgaatcaacagacttaaatcagtcaccaaatttgtaaatacatcacagaacaagcaacgaaatggcaatggcccatttatattttgaatttcaaggaaagaaaaggcattacaggtatctaggcaggataaaaaatcagttttaaaaaacagcatatgcacaggcaacaaaacattctgccaaataattaaaggctttgaacaactacatataatcctaataaactgctgggaaaagtattgtagttttccaataagttagttaagatttcttttaaaaaaagatagtgtagcaaagagatgacacattaaattagcatatataaatcaatcattttcatatatgtaaacaataaaaagtatatataggaagaaaagacccacatataataataacacataataaaataaccgaaataagcttagtaagaaaagtgcaaagtctatattttaaaaactttaaagcactcctgaaagaccacatatcaaaattgaagacatgaaaagatagagtatattcttggttagaagacaactctgtaactgagcttgggattacaataaggagtaggtttgagaagtggaaaaatcggggttccattttggttgtgttgagtttgacgtttcggggagaggccttaggcactggagaagtgagtgtggagcactgtggagaggtcagcatgaaagttatgaattggagcattctcaacatatgtcacttagcaacagcgtgtagatgcagaaaggagaggaacctaggacagaaacctgaaccttccaacatttatggattagctgagagtgaaaagccaccacagaagactgagaccaaaccaaatggccagtgaaaaggatggaagagtatgagtgtgaaattctggaagcaaaggacaatcaatttgttcaaagagagaatattcattctgtattcccagtgcctggcccatggtaagaactcaataaatatttgttagatgaatgaaagtgtgaaagaagaaatggaattttcctagaaagatatattttataaaagtgtactcacaaagcagaagaaaaacattttagactaattccatatatgtgtattatacatatatgtaaactaaaaaaaatccaaaattttaacaaaaagttcaaatccatctgtattctaaaataataacaaaatatgactacatgtctaatggtaccaaaatctctgataaaatattcagccaaatgtgtcctggattgctgtaatagaaatgagttattaagtgctcattgataaaatactgaacactaagtctgcaaataatatagactcattggtcttaagtatggtcctgaagatcattcagccttctcctcctgtcttcaaatgggccatcagaacctgctcccatacccagaattagtctcttcttccatcttgccacaaaaccctctttcagcaaattattgacttctagaacatcaaaccatccctagagatcttcaaacgaccacttggctaccagagagcacacaagacagaaactaggcatgggtttctttcttattttaaaacatcttcagggagtttttgatagagttaaaactagacttggcattataaccacttagtctcccttcatgaccagtttcaaaaggcatgattggtttcatataggcagccaccaaagtaactttcataatatcagctacattattaaccacatcaaattgggatcagaatagccaccagattgattcattttccatgtgcacaatctgttacatattcagaacaatcattaatgtttcttaactcttcttgaaaccagtacagagccttggattttgtctagggtgaattacttcattcaaaaaaacaaaccaacaaatcagaaactaatttttcagcctgtcataaatatgactacagaacatgtatgttccttcctggatacatttgacttcatcttgtcataacagcttctaatgaatcttaaaaacttcctcaaagtgttcagcaagcaaataaaatcagttttccatgcacattatagctaaaacaagatcctacctgtaaattataaacaatgattgtttcttactagcttatgatatctgtgaagatttttcctgtttcttagatttttactgaactacaccttcaggttttttttgtttgtttgtttgtttgtttcgagacagagtcacgctctgtcacccaggctggagtgcagtggtgtgattttggctcactgcaacctccgcctcctgggttcaagtgattcttctgtctcagcctcccaagtaactgggactacatgtgtgtgccaccacacccagctaatttttgtatttttagtagaggcagggtttttcaccgtattggccaggctggtctcgaactcctgagctcgtgatccacccacctcagcctcccaaagtgctgggattataggcatgagtcaccgcgcctgacccagtctttaccttacagaaataatactcttttaaatctacttcacctctgatccttaatagtctttgccaatcagtagtttcctgattagccatgactgtgtcaatctattttttagcactgggattatttgtctggtcctatagttttaaaaaaacaggcatgccactgaagtgaggctgaaatgtgaacttggtaagactgtagcttcccttcctattaattatctcccctttcacctggtgataatatgatgctggcaatagctgctttgtctttacctaattgttttaataccacttaatcttcaacaatgagtattttaaaagctcatgtagcaaatgagctgggggtgtacacaggcctttatggacagaatttgagctgcatcttttgatggtattgctttataaagctagcttaaaatgagaaaaaattaaaaccttgcatcttcgtatactgttaattctaaaccattttaaggcaataattaccagaggcaggaaccacagctatgccgagttcctctctatcgatagaagggtgtgttacataggttggcatatcactgaccttttctgcagtcactgtaatgccagcttttcataactattgttttctgttttctcagaatcttctctgaacaatatgcatcttattttctttcagtgatgtgaattgtttgccacgtgtgaaaggttttacatattttaaaaaagccactaaatgtagctgggcatggtggctcacatctgtattcccagcactttgggaggccaagtgggtggatcacctgaggtcagaagttcgagaccagcctggccaacatggtgaaaccccgactctactaaaaatacaaaaaaattagcctgatgtggtggcacgcgcccataatcccagctactcgggaggctgaggcagaagaattgcttgaacctaggaggcagaggttgcagtgagccgagattgcaccactgcactccagcctgggcaacaagagtgaaactctgcctcaaaaaaaaaaaaaaaaaaaaaaaaaagtcattaaatgctttgcatatgtaggatcttgttccaggcaatgcaaagtgtgaactcataaaaattgttcccttactttggaaattagttttctgctacagaatagacacaatgtccaacatggtgaacaggtttatgacttaaatagagcgtttctctctctctcacacacacacaccatgtaggcacgagaaaaaaaatcagaattacaaataaaatactgatttcaaactgtatttaaagatgtagttaaggcaaaattataagttaatgagatgtatgtgtcttatagaaggaaagttcattaattcataatcacttgccataaattatatgtacaattattttatggacatgtatacagctgatccagtctaacgatcaccgatgacctgaatcaaataatatggcagaattaaggatgtgaaaaattgtacaaatatgctaactttcagtgaaatatgttttgactaccataaaatttatataaatgttaaaagcacagttcaaactgaattataatttttcaggaggtttgcttgcgtgccatattaaaatatccctgatgaaacatatttcttaaaaccactaagaaaaaagttcttgcaatgggaaaatgatttatttacctggatcttctatagttaagttctttatcaaccattgaacaatgtctgaacctagaaaaagaaaaaagaaaaacacaaacagatgtgaacattttgtttatacatattaactttaagaattctccacctttggtgctcatattagaaggaacttttctaattgttacaatgacagattaaggatctaccccagatggaatgctgaaaacacaaagtatggatacttagctgtccatcaataaaccaaggtgtaaactagtaaattattaaatatgaaatatgtaaatggaaataaaatttactgtactagtagaaagtgatttgtttactaaataagtgtttattaagcatctcctatatttcaggtacaagtcttagcacagcataaccagtattttataaggtagttcctgtctcatttttggttgtacccacctcatccttgtatcccctctcaagtcaaaccaaatttgtttttggttttcgaaccctcttacgtatttcaagtctctgtgtctccacagcagtactctccctgaccgaaatgtcttcccactatttttaagacactcaagattcactgatatgacagaacttgccttggcccttcccctcgtccactgagttcacagtactgtccatgaaacctcattggaacccatgcagtcttttattgtcgtgttgatcacacaccattgccccagctgtttatttgatgaatgccccaaagtaagaaccttgaagcagggtgtcatattcatctttgattatttggagcatagtaagtgcttaacaatgtgtgatgaatacaaagtatgagcaaatatgtttctacttcacacagaagagacaagagaggtctgcagaaaacaatgtttgagctagattttgaaggatgtatttttatctatgaataagagagaaatttagttgctgaaggggcctacgtaaaaactaaaaggtggaaaagcagtcaacagaaataatttactgcacactgtctatatgtaagtgctgggaataatagaaaattgaaagtaataatggagtgcacagtatattcagcaggtcttgaattctaggctaaagaattaaattttctttttcccataaggaaagcagagaaagagacatgcaatatttttgagcagaagaatgacattatcaaagtaagtttgaggagtatgactggcaatatatatgaaatgccttgtagtcaaaaagaaggcaaggcagtcgacatgtctactagttgcaatccaaggatgaagggaaaaggtcttagttcagtgtacaaaggaatttcttaaaaaattacagacttctttcaggactttacgactaattaggtataaaggttataagtaggagagattaaaaaagaagtcaaggtttctagcccggaagcatagatgaatagaatgatgaaaataagagcagaaatgggagatttagcaactgatttgcttgagacattcatttgtatttaaaattggttttctgcataactcttttctacacaaaataggaaaaatatgtatgtgaattgtttgcatacatagtaaactgtgttatgcctgcgtgaattgaatcaaacttcagtgtgaaccaagattccatttcagcctctcctggaggctggctagagttgctgtctacccacctcggagatttggcaaattaattacattaacattggcaaaataattctagctgcttgaattaaaccagttcaaaatcaatttaagaataaatttgattactaaacttgacaataaagtcccaaaagttatgagaacattcatactcaatgtcaatttcagcatgcatgcatttaaaaaaataactccaagtattgacttgaacttgtgttccttttacagctgccatggatttaaatcatttgggaagacagactcatccagatcctaaaggaagttttactaaaacagctctaagggtcaaatggaaaggagatcattctccagaaggcagttgaccgtgtcccggtgttgtgttcaaccttatagtcttaggttatctggaagcacgatcttcccattgaaaaagaaaaggagaactcagcttttcacatatacatgtagtgatccttgaccaatgtcgattcccagatacacaaatcttccgcacaagccccaagcaccctgctcatttttcagagttgagcatctatttgtggaacatatgtgagcagccactggaaattttccattcttttgaagacagccaaacattcattccaggactatacatattttttattgtgaaaaatgacttgaaaaatgctcttagagactaagtttttaaaaatattctgttctgttacgctttctttccttttctttttttttctgggcagaaagaaatacaaagaagcctaatttaaaagtatgtttaattcagagaataggaaactttctttcttagcctacttttgagtatttctgtcacaagtgtattctcagttcagctctgaaggagtcaatttaattggacttgaccaactgctagtgccacttagcagatgctgtagtagtttttttattgtgtgatcgccccagcatatttatggttttaggttatggatttttaaattgttaaattcttacccagactcaccatgttaacctatgctccatctgtaagagtaagacctcaactccttgaagagataggtagagagagaaagaggaaaaaaatccagtatcttattggaaccagaagactgaaagagaaacgtgctcctatagagtcatcttgagaagcatgactcaaatttaaaatggagcattacagtccagagaagtgtagtaggaatgccacctttacagcaattttccagctttatattaaataaataaataaataaataaataaataaataaataaataaatggctgggtctgctgaagtttttcacatataatgtatatgtagaaaattgtagcattctatttaccttgattttggagccctcaaagtaacctgtggaattttttgaaatcacactttcactgtagcctatggaaagtttatacaggcatatgtcacttttagagttgcagagctttgtgctccgtctgctcagcagaagcagtagaggttttattactgtcgaatcctagcagtatattatttaaaatgaaaacaagcaaaaacaaacaagcagaattcttcctcatcacactgctcatagttttctacctgctatactgtttcttccttccatgattttgctaatgctcttctatcttcatctctttttcctgtggtgaatcccaactgaggccataaagttcaattcaaacattatctactccaggaagcctgttgtgcccacccctcaacaaaagattgaatgaataaatagcaagactcccctccccaaattctattttcacagagtttaaaaagaatagtatccttcatgcaaagaatattctactggcatgtaatttaaacaccactattattttttttttttttttttttttttttttttgagacggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctaaacaccactattattaaacatgatgttaaattgatcttaaacttcaacattattttttcacccatgccacggatctgaacggcaaacgagcttccttacctgtgccccctgcagagtgcaaaggcctggaccaggctctgtcctaagcctgtattacttccattacggtccacgtctgcacccctccccaggattagagcacatcctcagctacaagtgtcacctacagctatccacaaactaaatctgaattagaggtgcacaaaaatattaagcattcatgaaaaaaattgcaaaatatttgtaaatataagatatgaggactctgtaagcaagcaaaatagaacacatttgatttgcatcctttacaaaactcaagtattttcataattttcagctaaagacattagtgaaaacttgagctcttaatcaccatagaaggtgcgcaaattattcctgaggcaaagacgctgacctttgcaatgtttctctttcagggaaatggaaaagctctttgtactgcccaaatacctttgctgaagcctcagaaccacatagacacagtgctgacaatacaaatatttttatttagtgaatatcataaataatccttaatccatgatttttgatgttataactattcttctttttttttttttttcctttgaagacagggtctcactcaggctgcaagacagtgcaacaatcacctcatcgcagcctcaacttcctgggctcaagcaattccccctgtcccagcctcccaagtagctgggattacaggtgtgagccaccatgcccggcaattttttttaattattattttttggaggatggggtctcgctatgttgcccagacttgtcttgaaatcctggccttaagtgatcctcctgcttcagcctcccaaagcactgagattacatggcatgagccaccaggctcagccaactattcttagaacctctcactaaatagaagactttctatatactaaaaatcatttttccaacattattctttgttccttgaagtaggcacaataaatgtttattatcatcaaatagcatgtaataaacatctattgcgtttctgtagaagtttggctgaggatctgcactttaaggaacaagaaagaaagaatgtctagcgaagcaaattaactgatctgtcagtcccttgagagaagaaacgacatcatactcatcacgtttccaccattctcttcaaagtgcttcaacacagatcatcgttaaatgtttactgaaggcatgagtcactatttatggacatctactctatacagaaaagactccaaatgctgaaaaagtcagctctaatggtgactccatctagtatgttatgacaccacagtgtatctctcattatcataatttaaaaagttcttcatgcaattataattttaactcaatttaatttaaaacacggcagaatttctttaaattaaactcaattgaatttctttaatttttaaattaaactcagtttaaaacactgcagaatttctgtaatttaaaacactgcagaatttcagtttaagttaaaacactgcagactttctgtttgagaaatgaagtgatttgcttaaagctagcatattacccttttgtaaagctgaattaatgaactaaatttctccacaatctttccaataagtaattgctaatatctaagaataacattttgtttatttgagtacttgtgtcctgtccagagccttaaatatgattgcacagccattgtcacatctgagggttcaacaaagcaaccttcaaccaaaggagcaggagagatgaactccagcccagctacagactatgttctctaaccccttgatctaagaaatctcagcaatggcaaaaatctggatatcaccaattaatggccggtgtcctagttctgtctgcctttggccaaaagcgggtactgaaaaaagagaaaagcagccactggcttccaggaactggctgggcactcacagctatgtcttggtgcttccttggtaaatatgaacaatttcttagaagaacattaacaccggacaaggccactctagaaccctcataggtcaagataaaaacaagaccactctgtaatcagatctgaacacaaacaaaacatgaacatgggctgagccataaaatatcaaattccatcctggataacatgagcgactgctgcttctttatcaatgccatatttagtcttgtctaatctgtcctcctgtagaaaaaatgtattaagatacccaatcaggccggccacggtggctcacgcttgtaatcccagcatgttggggggccgaggcaggtggatcatgaggtcaggagatggagaccatcctggccaacatggtgacaccctgtctctactaaaaaaaaaaaaaaattagctgggcatgatgttgcgtgcctgtaatcccagctactcgggaggctgaggcaggagaatcaaaccagggagctcgaggttgcagtaaactgagatggcgccactgcactccagcctggcgacagagtgagacactgtctcaaaaaaaaaaaagataccagataatggaattgtccctacttcctgacagcacccaatctagagcaaaggcccacttcctcagatcctctccatgactaccaatgccaaaatcctgtaatagattcttcctaaaaccctattactgagacaccccatggttcccgatggcgtgcattctccctaccctcaagaaagaataaagttgacttgttcgactataggcgtgttcctggtggttttgggctagaggcatcgacatttttttaatttaaaaaaattgctaatatctattaagattaatataacaacaacaacaaaatttaagttacttcatcagggcgcttttggttgtaaagagtgatctttgagggaagtataaaaacataaacttatcaaagaaggaatttgcaaaaaggtacccagaactaaagggaaaggatgtatttaggcctcaaggactcatggaggcagagactgtcatccttgctcctttctggacatcttcatttctctctaggaaacaacctttgctattttccatccacaaagtgggtcatgaaggctcacagctcctgggttaaaatctctgccactgaagacggcaagacatttgaggctgaaatcttttagtcctaagtcttaattcctgatgaagggtctcagctgcagggaggtgcccattcctgtatcagccaactgtggcaagaaaagatggatcactgtgcataaaaatggtcatgctggcgagaggtatcgatggaggcattttccagaaagaatgagtgctttgcagacataacaatgggtgtaaactacagcttccttccagtttgtaaagcttttatgtttcatcataaaaaaaaatgcagaaaagagaggaaaagtggaattcaaaagcaaaatgtcaaattttgaatgaaacgaatatgttattctgccttgctatgaatataaatgtgttttgttctatgaacttattatagtcccgtaaagcagagtaggaatacattgtttttgtgtatgtgaatgaaaccacactttatgtgcactaaaacagctactcaaagaaacttcgtgatgtgtatatgattttgtgtttttatgagtgggcatatttttaagtaaataattcactttctaaaatgaataacatgtaattgagtattgttacttctggatttttatacatcaggtatatctagagaaaattattcagttttcatagaattaaaaagattaacttctgctcacagtttgaaactggatcaaacttatgatataaagcccttcttccaatattccatagctaataacacctatgaaatctcaaaggtcaatggaaacaaaataatcaaaacagatatgtttcctttcagtaaacctcagatacatttgaagcatttgcctacgagactttaaaaatgttgttcagcagtcatttaaatgcatttgcagatgtcatggcaaaaagcaaattatctggttgattacattttctttctaggttgttgctctttagagttctctgccccttgccctaagagcagagtcacagaaaatgttgggttttgttgatataacttgaatcttcaaatcaacaggatagaagcccgatattcactgtaattactactactgtgttctgaggataggaaaagtaaaaatatatttccctaccctctggcaaggtacaatgaaaacaaattagagttctgtggtagagctccttggctgttccttgagcagacattttctcaagatcatggggatttaactagatttttaatctttgttgtgtaagttccagaaatcataaaaatatctcttcagacgcaaagcaggcattttgtctctcttcaaagcccaagaagctttaaacctaggcagcaaaaacagcaaggcagcaaagatgacaataatgaggagataaaaggtaatggagaccaccctcaggattatttcctgccctctactggagctcaggaggattccttatcaaccagagaagcttttcccaagtcgcattcagagaaacatcacgtctgcctcttgtgtgggatggtgacagtaagtgtgggaaatgcggagttaagagaaggaaggaaaatagggttccttgatgtgcagcctttattttgataaagcaagttgtagaaaaatcaagagaagactaagtccgcagtgtttccttaggatggggatattggatccctttttaaagaccattttatatttttatgttttagttctatggttctttagactcaaagaaaataaaacaagtaataagtgtgtaaaatgttcagatataactatgaattttgggtcagctaccatattggaacacattagaataaattatttattaatcgattaatcaattccatatgctagctggtaggcataaagaaaatcctagtggatcattcttgccctcaacacatatatttttttccagctacacacaggccatgtctaactgtctaactgcctctatgaaggacataggagataaagaaaatgtttattgatcgataaattaaaaacttgctcttgactggataggcacagacctcatcaatctagtccagacacagttgctgtatctgttgacaggtagagataatactttttattctttattagcagagagtaccagcattggtcaagaggtggatgaggcagaaggtacaagtagatcaaagaggattccaattccggaaatttcccagttcattaaagattgacaaaatgaatgcacttatgcatagtcaaaactacagctcaggccgggcgcgttggctcatgcctgtaatcccagcactttggaaggctgagatgggtggatcatgaggccaggagttcaagaccagtgtggccaagatgctgaacctcgtctctactataaatatgaaaaaaattagccaggcgtggtggcgtgcgcctgtagtcccagctactcaggaagctgaggcaggagaatcacttgaacctgggaggcagaggttgcagtgagccaagatcacgccactgcactccagcctgggcgacagagcaagactccgtctcacaaaataaacaaaaacaaaaacaaaaacagaactacagctaaggccaagtgcttttgtgccaatcctaattattttggcactgaacgtgctctatatagtgctatgtatagaccaaggcccagattgaaaagagtgaatctttttaaaaataaccctgaatatttcctgctgtgacaaaatattgaaaataccaattaatgatgccatttttggggttctatttaaaatgttttctattattgaagatgtaatttcaataccatgaggtattgaatgatcacgaggtcaggagttcaagaccaacctggccaaggtgctgaaaccttgtctctactaaaaatacaaaaaaaaaaaaaaatattagccgggcatggtggcgtgcacctgtaggcccagctactcaggaacctgaggcaggagaatcacttgaacccaggaggcagaggttgtagcgagtcgagattgcatgactgcattccagcctgggtgaaagagtgaaactccatctcaaaaattaaaatgaaatttaaaaagaaagaaagagggagagcgagaggaggaaggaaagaaacagaaggaaggaaggaaggagggagggagggagggagggaaggaaggaaggaaggaaggaggaaaggaaaggaaaggaggaaggaagggagggaaagaaagaaggaaagaaagaaagaggaaagaaggagagaaaagaaaggaaggaaggaaagaaggagaaagaaagagaggaaagaaagaaagaaagaaaaagaaagaaagagagagagagagaaagaaagagccaaactattttccagagggcctgagccattttacattcctaccagcgatgtaggagtgattcagtttcttcccatccttgctaacattagtgttcctattttttagttcaacctttctgatagtatgtgttgattttcatttgtgtctgcctggtggctaatggtattgaacatgttttcatatgcttttttggtgtaggtacatccttttctgtgaaacgtctcttcatgtcttttgaccattttctaattaattttttttgctattgttttttcagttctttttatattctacatactagtcctctcttggatatgtggtttacagataatttcttttactctgtaccttgttgttccaccctcttcacaaggtctttttcagaaaaaaaaaaagtttttaatttggatgaggtccaatttatcaactttttatagattatagtattaaatctaagaactctttgcctagaccaagatatccaataatttctcctactattttcctaaattttttttgttttaattttccattttgtattagtgtttgtataagttgtgagacttaggtggaacttcctttttgcccgtgaatgtccaatagctctagcaccatttcttgacaaagctatctttcctcagttgaattgcttttccatgtttgtcaaaaatccattgtgtctatttgtgtggatctatttctggattctctattctgttttattgatctacatgtctatccttctaccaacaccacacagttctgtttaccacagttatataatgtcttgaatatataatataaacataaaataaattcctcccacattatttttctttcaaaattgttttacctgttctacttcatttgctttacctataaatcttagaattatctctatatctacaaaaaaatcttgctggggttttgaaaggaatttcattaaacttgtgtatcaatttggggagaactggcttttatacaaggttattcttcatggatttgaagtatgtctctccatttatttacatcttcttttatttctttcaccagcattttgcagttttcagcatacaagtcctgaacaaactttatttgattaacacctatttaatttttgggcaattttaaacagtattgtgtttttgatttcagcatccacatgttcactgttagtatataaaaatgtaatttacttttgtatatttattgcatatcctgtaatctttctggactcgattcttagttctagaaggtttttttgcagatattttgggatttaacaggtaaatataataccatctgcaaagaggggaagctttaatttcttcctttctgatctgtgtatctcttatttccttttcttgctttattgccctgactagaaatttcaacattatgttaaataaatcctcaccttgttctcaattttagaggaaaacattcactcttttacaactacatataaagtaaacttattattattactattattatttgagactgtgtctccctctattgtccatgcttggctaattttttaaatttttgtagaaatagtgtctcactatgttgtccagccaatgatctcaaactcctggtctccaagtgatccttgcacctcagcctcccaaagtgctgagattaaaggcatgaaccacagcacctggcctaaagtttttgtagatgttctttatcaagttgaggaatttctcttccattcctgttttttgaaagtttttattatgaataagttttgaattttgtctactagcttttctatattggctaatatgatcatgtgatttttctattttatccagttaatttgctggattacagggttaatttttgaatatttaaccagcctgcatctctgaaataaacccacttggttatggtgtataattatttttatatattgctaaattctatttgttatattttgctaaggagttttacatcttaatgaaggatactggtttgttgtgttcttttctctacgttatttttctagttttgacatcagggtaataatagcttcataaaatgaattgagagatattctctcctcttctgttttctggaagagactgtgtataattgaatttttttaaagtctggtagacttttccagtgaaaccatgaacctggagattttgtttttagagatttctaaattatgaatttaattttcttaatagtcattgattgcgctattcaaattatccatttcatacagggtgagttgtaatagtctgtggtttttgagacactgatcagttttgtataagatgtcaaattatgtgtttaagtttatggtattcttttatcctttagatgtctgcaggttttgtagtcatttcccctgcttcattcccgaaaatggcaatttgtgtcttttctttttttttttttgtcttgttacagaactgtcaatttatcaatttttataaagaaccagctctttgtttcattggtttttaaattatttgaatgttttcaattccattgatttatgctctttattattttcttacgcttgcttgctttgggtttattttgctcttcttctatgttctagagtttggagtttagatgattgatttggaaattttcatcttttctaatgtatacatttatgttataaatatttctctcagccctgctttagcagtgttccacaaattgacatgttacattttatttttattgttttttttttattttccagaagatccttcaatgatattatttaaagtgtgttgtttaatttccaaatgtttggagattttccttttagttttttctcattgatttctaatttgattccattatgatcagagaacatacttggtataatgtctgttttttaaaacttattatgatgtgtttaatggcccaaaatatggtcttagggaatgtttcatgggaacttgagaccatgaaaagcaaaacaccatgctttttgctgttagttggaatatcctgtaatcaggtcaagctgattgatcatgttgttcaggtcatctacatccttactgatttttctgcctgcttgatctatggatctatcagttactgataaaggagtgttaaagtctcagctctaataatggaatagtctagttcttctttcagttctatccatttgcctcatgtattctgaatctctcttgttagatacatacacatttaagtttgctacgtcttcttggaaaaatgagctcctcattattatctaatgaccccctttattgcttccacttttccttgtggtgacgtctgcttcatatgaaattaatatacctattccaggtttcctttaatcaattttgcacaacacatcttttttctattcttttacttacaacctgactatgttgttatatttgaagcaagtttcttggggatagcatgtagttgagccatgattttatccactctgctggcctctgtcttttaaatagtatatttaagtaattacttgtattaaatgtaattaccgatatgtgatggtatatttaatgtaattactgatagggcttaagtatgccattttattttttgtgggttttttttcttgttcctgccttccagtggattgcattaatattttttaaaatccatttcaattttctaagtttgtttgtttgtttgcttgtttttacagtcttgctttgtcacccagtctggaatgcagtggcatgaaaatggttcactgcagcctcagcctcctgggcttaagtgatcctcccagctcagcctcctgaagagggaacacagatacatgctactatgcccgactatgtttttattattattatcattattattattattgctgttattatttagagacagggtcttgttatgttgcccaggctggtctcaaactcctgggctcaagtaattttcctatttcagcctcccaaactgctaagtatgattacaggtgtcagccaccgcacctagctctaaatatttttgaatgcattattgtgcagctctttttagttgatgataaaattatattcacacaacttattatagccttccggtgtaatcactttaccaatttgagtaaagtgaagtatggaaccctatgtctcttcatgttcctttactctccccaatttttaatgttttttagctaattcctctatgtacatttagaatcatatcagacgttgttacatttttttcttcaacaatcaaaacaatcaaaaaaattcagaaggatgggtgcagtggctcacacctgtaatctcagcactttgggggaccgaggtgggcagatcatttgaggtcaggagttcgagaccagcctgaccaacatggggaaaccccatctctactaaaaatacaaaaattagtcgagaagggggcacatgcctgtaatcccagctactcaggaggctgaggcaggagaatcacgtgaatccaggagacagaggttgcagtgagcggagatcgtgccactgcactccagcctgggcaacagagcaagactttgtctcaggaaaaaacaaaattttcagaaaatcagagaagataagtctattgtatttcttacatgtttgcttaccacgttttgttcttatctgatattccaaggttccttttcttatcgtttcccttttatttagaaaattccttttaatcattctgttagagttcgtcagctggtgacaaattctctcagttttccttcatctgagaatgttttcatttccccgttatgcctcaggaaaaatgtttgctgggcagaggattacggattgacagttctttcttttcagcaggaaaggaaaaattttgtggcactttcttctggcatccacggtttttctcatgagaacgctgctgtggtttgaatcatttttctcttctagttaatgtgtcatttttccctgactgctttcaagatgtttgttttgtggttgtctgcagttttcaaatgtttattaagtggcttggtatgcatttcgttgggcttatttatcctatttgggcttctctcagcttcttcaactgaaggtttatatctttgctatgcttgtgatgtttttaagccattatttcttcaagtactttttttttttaagttcagctttttattgaacacattataaaagaggtttcgtcaaaaagaccaaagcccatgtcaccatcagacttctcggattcttctttctttgcttccactttcttctcctcagctggagcagcagcagcagaggcgggcagaagctcctgctggtacagatagagccagctgctggaccaggtccaccagcccctacattgcagaggaggctccccatgttgactttggccaggcctttgcaaacaagccaggccaaaagggttcaacatttacaccggctgctttaatgagggcattgatcttattctccgtgacggtcacctcatcatcgtgcggaatgagggccaggtagatgcaggcgagctgggagacgaaggccatggcacgggtgagtgtggggctggcgctgccggacgcggatggaccgagcaccttggtggcagctgaggaaaggttcttcaagcacttttttagtccccttatctttttcctatcctttcataactccaatggcaccaatgttagatcttttgttataaacccacaaaagatctccatcccagaggccgtgctcctttttgtcagtctgttttctctccgctgttcagattaggtaatttctgttgttctgtcttctatttcactgacttagtggtttcttccatcttatcgattttgccattgagcccatccactgagttttcctttttgatgttgtccttttcagtcctaaagtttccatttttttataacttctatttctttgctgagaatttcagtttatttcctgaggccttctagtttgtaatatgcttaaagcatattattattattattattaaataatttttatcatagatcaggggtgtccaatcttttttggcttccctggccacactggaagaagaattacacataaaatacactaacactaatgatagctgatgagatttttaagaatcacaaaaaaaacaaccaacctcataatgtcttaagaaagtttacgaattgcttttgggccatattcaaagatgtcctgggccacaagttggacaagtttgtcatggatacttcaaaatctttgtaagctaatctattaactctgtcatctcaatcttgaccactattgatatatatattttttccatttagttagaggtcttcctggttcttggtacgatgagtattttgttgttgttgttgttaatacagcgtctcactctgtcacccaggctggagtgcagtggtgtgatcttgtctcagtgcaacatctacctcccaggctcaaatgattctcgtgtctcagcctaccaagtagctgggactacaagcatgtgccaccacgctcggctaattttttttttttcccagtagagacggggtttcgccatgtcggccaggctgttcccaaactcttggcctcaaacaatccacccacctcggcctatcaaagtgctgcgactacaggcgtgagccactgagcctggcctgatgaatgttttttaaaattgaaagctggacatctttgtattttgttatgcgattctgggttgtcgttggcttttgatgacaccactcctccggaagagggaaatgctgtttcatgaccacctgctgagggtagaaatttgacactgcagtgagggtggcctggtcaccactgtttgatggcagaagtctcgatgctcccttaggcttcttctgacaccactccagggtggagaagtggggtgttattactaccaggttggtgtgggatatccagtctcctctcgtgatcttcactgaaatgtggatgggggaaaggaggtctcattcctgacaagaagcagaccagtggtgactagggatggggcggggtgagggaaaatgaagaaaaatgggtttcaaaaaggcacaaggaaacttttggggagaataaaaatttctactattttgattatggctgtggttttagggatatattcatgtgtccaaatgcatcaaaattttatactttacagctatccaggttgtgtattaattatcccttaataggtataaaactcaaaacatctgaaaacaaagaaggaaatattttaagtctccttactcatgtcttcaatgtgaattaggttgtaagatggtaagactttctttttttcagcactgaatggtccagaactgtactgttcaatatgttagccactagccatatgtagctaattaattcctcatttatttcttttcttttcttttcttttcttttttttatacagagtctccctctgtcacctaggctggagtttaatggcgcaatctcagctcactgcaaacctctgcctcctgggtttaagtgattctcatgcctcagcctcccgagtagctgggattacaggtgcgtgccaccacacccagctaattttttttttttttttttttttagtagaaacagtgtttcaccatgttggccaggctggtctcgaactcctgacctcaggtgatccacctgcctcagccttccaaagtgttggggttacaggtgtgagccaccgtgcctgactagttcctcattttcactagctacacttcaagtgctcattacccacatgcagctagtgaccaccttactggacactgcagatatagaacccttacatcattaagaaactcttggacagcattggttcaggtattacaatattatgggaataattatctggatatgtgtgtgtgttcatgtgtgtgtgtgttttcataggctaatttttactttttcaaaatgaaattatgaatgtgaaagtgaatagtacaggacctaacacaatatagctatacaacaacaataaaaatgttagcatctcttccatccagtttggaaaatcttttatttgaaataagagtaagaagtcaattgagagaattccaaaaggtgccccaaagcaaaaacaaaagattgaggtttaaatgaactgtacggtataaaaaaggcaacaattttaaaagtaagatagtaaggataaatagtaaaatagtaaggctttctaattaagatacaaaacctagcagccataaaacaaatggctgataaatatgaattcacataaatttaaaaatttctatacagaaaagaagaaaaggcactataaacaaaataaaaataaataaataaatgactggtatacccagacaacaaaacatcattgagttctaaaaagaaatgaactaccaagccatgaggagtcatggcagaaccttaagtgcatattactaagtgaaagaagtcaatctgaaaaggccacacactgtatgactccaacaatgcgactttgtggaaaaggcaaaactatggagagagtaaaaagatcactggttgtcaggggtggaagagatgaacaggtagagcatagaggattgttagggcactgaaatgactctatatgatattccagtagtggattcttgtcattataacccatagaatgcacaacaccaatgataaaccctaatgtatactatggcccctgtgtgataatgatgaaccctgtgtgataatgacgcgtcagtgcgataatgatggcccctgtgcgataatgatgcatcagtggaggttcactgaaccgtaacaaatgtactactctggttgggacttgttggtagtggaaaagactgaggtatatgagagtaagaggtatacaggaaatctctttacctttctttcattttcctctgaacctaaaactcctctgaaaagcatagtcttaaaaaaataggcccggcgggatggctcatgctggtaatcccagcactttgggaggccgaggcgggtggatcacctgaggtcaggagtttcagaccagcctgaccaagatggtgaaaccccatctctactaaaaatgcaaaaaaaaaaattagccgagcttggtggctcatgcctataatcccagctacttgggaggctgaggcatgggaatggcttgaacccgggaggcgtaggttgcactgagccaagatcgagcctttgcactccagcctgggcagcaagagtgaaactctgtctcaaaaaaaaaaaaaaaatggtaccacactgtgaagacatttttgcaatcaactgaaaatggaaagtgtattcttccatgttgtctccccagcactcatcattttgctgtcacattttatatttactgatattagattttatgtatctttgttttaattgcccacttagacacagttcatgagagcagtgattttatttgtcttgcttatgcctgtatcttcagtgtccaaagtagtgcttggcatatgataagtggttggtgaatgaatggaaaaactttgagaaattgacaaagagaccagaaaaccaatagcaaagcaggcagaaatgtaaacaggatgttcacgtaaaagtcaaatacaaatgattcatattaaatgatgaataatctcattcatacttcaataaattctaattaaaacatatgaatacaagttttcactcaatacattcgtaacatgaaaacaaaaaatttataatacaccactttgaagaagagataggcagcaagagttttcatacacttgttagtttctttgtaggatacttttacaatacttataaatttatagttattacttttataactcagcacatgcactattttaaaaatttacactattggtatactcgcaaataaatgtgcacaaagatatatactcacacacatacacaaagatacttattttatcattgcttataatgacaacaaaaaaagtgctgtgccagccgggcgcagtggctcacgcctgtaatcccagcactttgggaggccaaggcaggcggatcatgagttcaggagatcaagaccatcctggctagcacagcgaaaccctgtctctactaaaaatacaaaaaattagccgggcgtcgtggcaggtgcctgtagtcccagctactcgggaggctgaggcaggagaatggcgtgaacccaggaggcagagcttgcagtgaaccgagatcgcgccactgcactccagcctgggtgacagagcgagactccgtctcaaaaaaaaaaaaaaaaaaaaaagtactgtgccaatacaatggatatcatgctattctgatgatgtgagcacttccctaagtgccaaccttactatcagaagaggacttggttgggaaggataatggaattccatcaagtgttttatcttcactaaggattttgagtttgcatcaaaacctaattactgcaaaaaagcatcaggacccatttccaaaccctcatgaaggggctctcccactcctgtatctgcctccagcaaagcactactgggatccactcaccagattatttatttatttattttttgagatggagtctcgctctgtcaccaggctggagtgcagtagcacaatctcggctcactgcaacctccgcctcctgggttcaagtgattctcctgcctcagcctcccaagtagctgggattacaggcatgtgccaccatgcccagccaattttgcatttttagtagaaacagggtttcaccatgttggtcaggctggtctcggcctcccaaagtgctaggattacaggcctgagccaccgtgcccggccactcacctgattattaaaccagattcatttaggactctgctgggcactgcgagggaataacataacagaagcatcatttctacccagaaggacttcaccgcctactaaggcaagctgtgtatagaggagaaagttaaatcattctgactactgcctttaatccaagactaaggcctgaaatcctgaagaatttacaaaatgcttagacctccattataaacttgcagttgccatccccagcctttcttactgctgcttggtaattcattttccaccaatttgttctctccttttgttcattccacaataatgagtatacatcgtgtaataatggggatactggcactgtggagagacatggtaaaaagaatggaggggtcactcttaagaaacctatttgaacagtatctgaagtgaggaaacagataaatagatcatataggcatgaaggaaaagcctctcctttgccctctgaaggttcattgaaaatcattgacaagaggcagattaataggagaaaaagcacacgaacttaatgtgtatatggaagccttctggatgaagacccaaagatatagaggaaattgtccatttttatgcttcgagtcaacaaagtctggaatatgactggacagaaagggaatgatctaatgctactagactgagtggggaagcccagcaacgcctgtccctctagattcttctggcctctctgagcagcattccttccttctgggtatggggcagagctctctctggactgggggtcttaggacctacagtccaacaaggcaggtcagataacttctttatgactacttttacggctggctttgaggagaaggggttctgatttccatgacccgcctcgggccagagggattctagtctctggggagaatggaacaggtcaggagaaggtcagagaaaaagtttgcttctgaggctgcttcagggtattgcattcttagtcccaacaattccaacgtggtaagtgctaggacagacttaagaacagccgcctacaggctcacatacatgaggtgcccaacacagactgagagagaaggaaagggaggaaacactcaggaacttgagtttatggtcagcttcctcccccattctttatggtgactgttccaatctttcaccatggttcaatttctcaatcacttctatgaagttgctcaaaacaaaagcaatatacagaagtttaactaaaaggtatagccctatttgacagagggataatttatacatacagttttgcacagattatatgcacagaattttagtccaaaacttgcaaagttctgacaaatgtatgcaccacgtcgattaaggtataaaacatttccattgtggtaaaaatttaaatgccctcctgatctttcacaccaagatcaccccatgccctgacaaaaaaaaactaggattctcatttctgtcaccacgttttagttttgcttttatgaaatgaaatctcacactatgcacttgctagcgtctggcttctttttatttactttttattttttgaaatggagtctcacactgtcgcccaggctggattgcagtggtgtgatctcggctcgctgcaactctgcctcccaggttcaagcaattctcctgcctcagcctcccgagtagctgggattacaggcatccatcaccacacccacctaattttttgtatttttagtagagatggggtttcacttacgttggccaggctggtctcaaactcctgacctcgtgatccacccgccttggcctcccaaagtgctgagattacaggcgtgagccaccgcgcccggccacgtctggcatcttttgctcaacatactgcttttgattgtcatccatgtcattacctgtattcgtgttccaagttgctgagtcacttccactgtatgaatctactacaatttgtatatagaccttcaaattttttccagtttatggctcttataaaaaatgctatgaacattcttgcacagagcttattgtagacatatattttcgtttattttggtaaatcccttccctctgcctttggtagacatataacgtagtattctgagtcttaaaagttagaaggttaggataaaaaaaaacccagtggtaaaactgtatcaataattctcaatctgatttttaagtggcctcagttataatcttcccttgtctctcacttcaattagaaaatgaaggttagcaaatattaatgccatcaatatacagcctccatacacatttatctgtctttatagctcctttctcctgttttctgttggactttgaggaaaaggtttctgttttcctgtccaaggcaaatccctcttcatcttattttctaccatctcctcaggagctttactgtactttgccctcaagtctttttcatattaaaaaaatgtctatatcaagctcgctagacaagaacatggcacacacagtctggcaaacaagaaatatatataaataatcctacaaacagttacataaagtgaaaagttctgtaaaggaaaactagagggaacaatgaaagattaaaacaacagatcctgatttagtttggaagctcaagagacttctctgaacacttggatagaaaacgttgaaactacagatgagagagaattataaataaggaaagtacttcaggagataggacagaattagaatcaaagtacagttgatgcttgaacaacacaggtttgaactacacgggttcccttataggtggactttcttccacctctgccacgaaagatagcaagaccaacccctcctcttcatcctcctcctcagcctactcaacctgaaaataataatgaagccctttatgatgatcagctcctacttaatgcataggaaatgcactttctctttcttcttcttcttcttattatttttgagatggagtcttgctctgttgttcaggctggagtgcagtggtgtgatcttggctcactgcaacccacgtttcctgggatcaagcgattctcctgtctcagcctcctgagtagttgggattatagacacatgccaccatgcccagctattttttgtatttttagtagagacagggtttcaccatgttggccaggccagtcttgaactcctgacctcaagtgatccacccatctcagcatcccaaagtgctgggattacaggtgtgagccactgcgcccagccttctttctttagattttcttaacactattttcttttctctagcttactttattataagaacacattatcgtaagaacacagtggtactttactaccacttcaagtatgttgaatgctcttttattcttggatatataataatagggcataatatatataatgtacaaatatatgttcatcaactatttatgttattagtaaagcttttggtcaacaataggtcattagtagttaagtttttggggaagtcaaaagttacagatgggtttttgactgcatgggagttggtgcccctaaactctacgttgctcaagactcaacggtgtaaggaatttgatttaggtagaaacagagtcaaaaccctttttctgagatagaaagaaagaatttgactagaaagtgaaatcagtttaaaagcgtggtatgagtatgtgtattccttatttttcctatgaaccagaaggcctgacaatcttttgagggagctgaggatgatacttgaaatttgaaggaagtggtgagaagttagaagtgctactataagaaatgagagaggctgctggcaaggaattagtaaaaggtttgctgagaggtcctgagggcccaggtgagggtggaaagcacctgtgattaaggcgctgcatcttgtacctgcaacacccaactgtgcgggcacatgcgcacagggacaacaggtggttttaaggtgtgtctggcaaaggccctggaggctattcaatgggaggaggaagtaagaaaattgttaaaagaatgaggacatttaaaagtcttgaagcgaaaataaagttaggcaaattctgccttttctgcctccacacctcaaatatacagatatgggacctgtatgcaaagatccgtccctactttatatggcaacaaaagacaaacaaacaaacaaacaaaacaaacaaaaaaacaataacaaaaactgtccttcaaaaaagaccaagtttcttttaaggccaaaaatctaaaaaaaaattctaaagagactgagcctgtaaaagagtttctatatatagcaaagattcagcaactgagataaaactctattttttctcctcttaaaaaaatggagatgccagaacattacctagacatgaacttctcacatttcaatgtgcgtataaatcacgttgttaaaatcttgttcagatgcagattctgattcagtaaacctgggttgggagcctgagattctgctttttaacaagctcccgggtaatgttgctgctgctggtcctcattgagtagcaaggatttagatcacctgaggagtgtaaatcaactctgagtgactcaatggggcttctgtgtttgaaaattgtaaaaataaataattcaaaaccaaagctgttgaaactgtaaatttttttcagccttaatggaatgtggccgtgtgcagaggctcacatctgtaaacccagcactttgggaggctgaggtgggcccatcacttgaggccaggaggtcgagaccagcatggtcaacatggtgaaacccatctctactaaaaatacaaaaattagctgggcatggtcgcacatgtttgtaatcccacctacttagtacgttgaggcaggagaattgcttgaacctgggaggcagaggttacagtgagccgagattgtaccattgcactccagcctgggcaacagagcaagactctgtctccaaaaaaaaaaaaaaaaaaaaaaaagaaatgtgattatgacattcagtcataagacagacagctataacctaggcagctgtaacctttgtttctctgattatagattggcctttactttacttacattgtttcgtaaaatgtaataaaggattaaagggcaccagagaagaccccttgcctcttcattgttggatcttcattatagattaacttcccttttacttcttttatacaaagacctcatgactatcacacagtctgaaacattaaatatacccttctaaactggaaaagggaaataaaacaagctgtaactaatcaaattgctgtaactcataaaccagccttgtatggaaaatattataatccggttaaatttctttgttttctgcctgtataagcaagaccttaacttttcagcttgggagcactgaccccattcctttggaatctgggttacttacatgaccattctcagctttgcacatgaataaacacttttaacctggattctgactctttcatttatttcaggttgacagaatgtaggaagagaatctggcagatctcagataaacagcaaaaggaagagagaaggtcctttgggtccctgtggtgaaggagtctatagtgacctgaattatgaaactgccccatagccttggaggttagagttcaaataggaggtaccattcagatttcccagccattactgagttgaaaactggtggcatcaactggcaccctgtagataaactgacacacgactgtaaacccagaaattggaagtgaacacttctctcactgttatacttgaatgggcatgttagaaggcatactgcaaattgttggaaggagagtcaacaatgagggacaaactagaaagtggaagaaataggtcagatgaaagttcaataacaaagcattaagttgagatggtatttggggtagtacctagtaagacgacttaagaaacatggatgaagctggaaaccatcattctcagtaaactatcacaaggacagaaaaccaaacaccgcatgttctcactcataggtgggagttgaacaatgagaacacatggacacagggaggggaacatcatacaccggggcctgtcagcgggtgtggggctgggggagggatggcattaggagaaacacctaatgtaaatgactagttgacgggtgcagaaaaccaacatggcatatgtatacctatgtaacaaacctgcacgttgtgcacatgtaccctacaacttaaagtataattaaaaaaaagaaaagaaacatggtatgactttctgggcttgtgtatctgaaggaaatggctctgaagtgatggctgtgctggtgctgtgaatgaacacctgatcatggtaccagtccacagtctggatgcttgtggtagagccaaagaattagaatttctctatggattgacgtttccaacataatacacatggatttaaacagttaaggcaaaagtgtttagcaacatatgctttcatgtcactaacctaaatccaccaggaaaaaaccccaagtggatcaagaactctgctctgtgatgatctctccctgacacattcagcacacagaaaggaatcattgctgatcgtttgtaacatgccaagaatgaaactgcattttgggatactttattttgctctcctccttagaggccaagagagaaattaaattaaagtccatagatcaaaagcataacttctcagctaaaaatgcagctacacattagttaacattcagaagaccaggccctttgcggttttgtgactttcaagttaatgtcttctcagccaatgcactaatttcctgctgatcctatcaatgggtcgcgtctgggaatcacagcacctacaatgtcaacagggagaatatgcagatgtctctggtggaagaggtgataagctccatcaaagtcttgatcctctcatcagaaaggctatcaccatttttcgtcccacatgggttttcccctctgtcaatatggccccgtgcctggtaaatctgcataatgagatggttttcataaatcacgtgcaatcaacacacagatttttttggacctctaaccaagactatatgtgttttaactagactgaatacataactctagtgaaataaaaagaaagtttgtctcaagcagagaaaagtcttcaaaagatggctgcaggagtatgcttccccagggagctaatctgtctgggttaggataagaaataaaatgattttgtttttcacatttttaaaaaagttcttgtggttgcaatatccaacaaaatgtactgttgactgcctcaaatggacagtgcatattcttccaggatgggcttggggactgaaaggcagaaggacatacgtgccccttccttcctggcagcaggggaggaaacggcctcatagaatggcagagagcaaagtagagcagcctcatgaaagaggccatggatgctgacatgcttgctggagaagatgaaagagatccagaaagttcctgtggccccttgagtgttagaaatgaaaaccaagtaaaaagtaagaattaagttgtctgctgggggctctccacagtgtggattgagggacctttagatgatggtgtcaaaggcattcgaaccagagtgactccatcttgagtaagggctagggaaaaaatgaggctgggacttgttgggctgtgttctcacaaagttaggtattcctagcctctaggtgcttactgttaagaaaacagattgataacatttactaaacagacccagacttaggagtgtcctgatatccccataccttgagaacagaagcattcttaattttgctttaaaggtaataatatcgattcttacaaaacatagtaattaagaaaattaatcctatatcacaaacccatgtagcacaacacatgatcttttgatatatatatatatctatctataaactagtattgtacctaaggtggatgcattcctccccttacttttggcaacgccctactctgtctatggagtagctgttctttattaataaagctgttctttcttaataaacttgcttttgctttgcgctgtggtcttgccctgaattctttcttatgtgagatccaagaaccctttcttggggtctggactgggacccctttctggtaacatcactagccagttatagacaacagtagtaatggggtggtgtggaggaagggagaccttacattgactatacccagagaacagaccgtgagctatatcaatgcaggaatattgaagagtgaatgcaaatagggcagagggcaacacgcagatacacaataggacatgacatctcaatgaagataggtgagaccggaggaccaaatgaggaccagaagccagggaaaagtccaaggtccctcatgcaaaggcacgagggcacacaacctacttgccttacaccagagtgctgtgcaagaaaaggaaggcagagggaaagtagatctgggaagaaactttccccagatgacagtaagtcaccagacagtggcaggataaccaggaagtgttcagttatacataataggcaagattaaaccacatttccaaaatctctcattatcccccttcctgacccttcatcagtcaataaaatagggctcatgaggacattcgggtcagttatacagtgaaggggaccaaaatatgtcacccaaatatacttctttggcatatttcaagatggctattccgaaaggctgcagacagaaatagtcttgcaaagctgccttttgtgctgcgagatttgcatctgtagagaaaatctacattggtgaaataaacacccaggctctctctgagtcccccttaaccagctctaggaaagattaactcacagtaaaaggagactaaaagtctgggacttttaaaggtctagcagagaaacttttaccactggctactaactgttctttctaatggctgggctgctacccgtgaggtttcatctgcataacaagatagcctttgcttgcaatgcattcctctctcactcttacataacctgtgatgctacctcctcccagaagccctaagcccctactcttctgtaacttcaggctggtataaaaatgtcagccatctgacccctcctttttttttttttttttttttttttgtgaaacggagtcccactctgttgcccaggctggaatgcagtggtgtgatctcggctcaccgcaacctccacctcccgggttcaagcgattctcgtgcctcagccttcccagtagctaggattacaggtgtgcaccaccatgctcaactaatatttgtattttttctagagatggggtttcaccctgttggccaggctggtcttgaactcctgaccccaagtgatctgcccaccttagcctcccaaagtgctgggattacaggcatgagccaccgcacctggccctgatccctgcttcgagtctcacactttgtgtatggctcctgtgtccacatgaatgttcacacatttgaatacctttttcttcctgtgactatgtcttttcttccaaaggtgtcccagctaagaacttgcgagggttaagaaaataaattatgtattttttctccccttcaacagaaataaaaagatgtaccctctgctagtgtcgtggtgttgttgtggtcaattttaaacaagctgcactagggatctgaaagggcccctcctccatttcatagctcagaaagcttgactgttgccttcactctgctggtgagaaaattagctcagcaaatatgtctcttcccactcaggcaaagcaaaaagaaatgacccctgtcaaggaatttaaaaagctgttacctaaaaggggcacaatgaggacattacctatctccattgtcttagtgttaggctacataattaaaatgactccaccatatcatgttcgtaaaagacataatgacaggaggggacagagcaaggtaatgtcgctcccaagagtcagcatattaatggggcctttcagtttgataatgtaattaaccttcttaaatcctactctcagtaaaattccaaggagcagaagctacaagaataatgtccttttcaagtaaccttactagcatcagggcattcacttgagaaatggtggtgatggtcaattcctgataaaagactttaaaacactgtttctaaaaaggtctgagctgccaaatatcagattcacatgaccaagcctatgttttcatcttcttctcttgatgaaaataatttctcctttctttcacaacctttcattttctacattttattgaatttgaagtcttgaaatgcaaagactagagagtcccatggtcgattctataaaatccaaatcatctccttcattggatgctttatgtctacaaccagccttcaatacataaaacatgagactgtccaacaaccaggtggcattggttagatagtatctctatgtatttacaatattattcttttatgcaatgttacttaaaggccaaattttaaacattaatagttcagacagcacttcaccagttttaaatccactggactgaggcactcaatgttacttgtctacaggtatctacagaactaaacttttgcaagctctctccagtcatttcgactgtggcccaatgatgtcacaggactgttgagacaacagaaatcactggatcagtcatgtaactaaccagtcattccctaaacatggaaactgctcaactcatttattatcatcctttgaatatgtattatgttccaggaagcaccatgatccttaccaagagggaagtaaaatatttccataaatatctacagttaaaagtttccatataagtggtagaaacaactatgaaaatcttgaggacgaatacatcattcctggatctggtgatcggaaaaggcatttcagctggccatgaagaataggttggtttccgtcagactgagagacgagactcttacatagagaaaaggattctccatcacttacatcaaaggaaaaatttttcatgggattgacaagtcatccagttcagcctagatacagggaaatagcgtgaggtaacactaaaaaagttgccaggtttcagaaaaccccttcagtctccagtgtgtttatgggcattgaatcacaaattgaaaaattctcccatttcatattcacaattaaggtacttctaaatctaaagttgcacagtttcaaaaagctttagttttcatctccaggctgtcaaagaaagtccaagatcttctaagataatcctttggaagctgagaaatagctataacttccaatgacagatttttattgtacccgaaatttcaagtttcattatgttcatctgtcgtgtactttctgggctaattgttctgctgtagcttagaacaaaaaatataatgcagaaactattcaataaaacctctcattttcacagttagggttcttaccattttttcttggttgctaatgttttcaatttggccatttgtttaaatttgcaatttgttagtaatttgcgtaacttaaacatctaatatataaacctttaacctattgaccattatagcttcatttcatagaagcatttataaacaaagtacatactagaagctgaatttgctcccccaaaagtttacagtcttgtgcattttagagtaaatgattggtcttgtactgattgatggtaacaaataaatgtcaacctcaattttgtattccaattttaacaaaattttggtacattgcttttaccattactatcaagtgaatttatgtaagttaatctaagaaatggcaatgatattttaggataatttcatttagatattttattcttttaaaaactaagtatattctctttccagtgatcaatataagataatatctattataagaatcaagtcagatcaaagtaaggcattgacttttttctgatctcccacattttagttgcctaaattgaatatttaccaagttctgtggcttgcactgcagaactgcactacattaagataactcccattaaacaaattcactttagtgtgtaatttaatcaagctatttgttcagtttgcaaccaggtcttaatttattgtttaattcagaggttactagaaaaatgctcacctaaaaataattaacctagaatctggcaaacttaccttataagaatattggcagaaatcctgtgtggggtgtgaggtacgatgggataacatggatgtgaaaaattatgaagatttggagcctgcctcacaccaaaccaggtttaaattccttagaaaaaattttacataaaaactcatgtctgggtgcggtggctcacgcctgtaatcctagcactttgggaggccaaggtggtctgattatgaggtcaagagaacaagaccatcctggccaacatcgtgagaccctgtctctactaaaaatacaaaaattagctgggtgtggcggcatgcacctgtagtctcagctatttgggaggctgaggcagaagaatcacttgaacccaggaggcggaggttgcagtgagccaagattgtgccactgcactctaacctggtgaaagagtgagactcaatctcaaaaaaacacaaaaaacaaaaatcaacaacaacaaaaaccaaccaaacaaacaaaaaaaaaaccccataacaacgtgagaacaaaagaaaacaagtaccagaaaagtgaccgtgtaatctatatcaatttagggagagacctgggactagagtactaatgtctctactgtaatacttctgtcatgtagcatttatcagagtctaaatttgaagtgggtttttttggagacagcatattgtggtctaattttttagtgcaatctgccaatctctacctttatgtggcatgcttatactattcacatttaaattgattattgctatattcagataaaaatctatcatctgtccacttgttttctactcattgcatttgttgtgcattttcctcttcttttactgccttccattgatttacctgagcattttatatgattctattttatctcctcttttggtgtataatttatgctgatttttataactttttaaggagttgccatagatcaacaatagatatttttaaatgatctaaatctatcctcaaataactctgtactcgtttattacaagtgcaggtacctaataacaaagacttcctaattcctcccttcccttgcagcattgctgtcattcagttcacccgatacattgctactactattgctttaaatgaagttatattttagattaattaagtggattgcttgaggttaggagtctgagaccagcctggtcaacacggtgaaaccccgtctctactaaaatacaaaaattagctgggcgtggtggcgcacgcctgtaattccagctaccagggaggctgaggcaggagaattgcttgaactcaggaggtggagttgcagtgagacaagatcacaccactgcactctagcctgggtgacagagcaacactctgtctcaaaaaaaaaaaaaaaaaaagtgagaaaaagaaaatatttaactttaccttcaattatgccttttttttatgttgcttctttgtgtatatacgagtttagtctttatttctctgtcacctttgaaacatgttagccagacatagaattataggttggcagatttttctttgaatacttcaaagatttttctccattctcttcttgattgcatagtttctggtgaaaagtcttctgtaattcttatggatgttcttctatagtttaagtgatttctatccccctctggttttctgcaagattttatccttttcttgatatgttatactgtagcttgaataggataagcctaaggtttttggttttgttttgctgttaatcctatttacccttttggtattttatgttgtctatttttttcatcagaggctttaacatggtaatcatagttattttaagtttcctgtctgttaattccaacatctgtttcatatgttagtcgggttctgatgactgctttgtctctctatttctttctttatttttttgaggtggagtctcactctgttgcccaggctggggtgcagtggcatgatctcagctcactgcaacttccatctctcaggttcaagtgattctcctaccttagcctctggagtagctgggattacaggcatgcaccaccatgcccagctaatttttttttttttttttttttttgtatttttagtagacacggtgttttatcacgtggccaggctggtctcaaactcctgactcaagtgatctgcccgcctcggcctaccaaagtgctggcattacaggcatgagccaccataccctgcctcgccttgtctctttagactgtgttttttcctcatgttttcgcatgccttgtaattttttgttgaaagccaggtatatcatatcaggtaaaagggactcaggtaaatatacctttagtatgagattacctttatttatctggctagcagttgggtcatgtctaatgtttgttgcagctatagataccagaggctttaaattcctctagtgtttgttttgtttttgtttttgtttctatttttttgtcttttttcttgatttgggggatattcttggtacaagtcttcaagaatgtgtcttgcaggtctttcagctgtaatacattgttactatactggaggcttattggtgtgacggtaaggtggagcggaggtggggggcattctataaacttctgcataagtctcatttagtgagactttttcttggggctgtggccttcacaggtgtttctgtccctccctcctcaaggggtagaggtttttcctctactttccctacttccattcatcgcttcagtgttctcaatccatttcctggatgtcatataccctgataattaggatttttcctttttctttaggtgagatatgctcaagtggggcagaattccacttcacaagctgggataaggtttcaaaattgccctcaggaaaatttattcccctggggactaggcctttgttaggcacaaagtataggacacattctctttcctttcccctgcgaaggccatgaggggatttttctcagagcctaaccatgaaaatctggtgctgtttttaaagggaaagcctacaatatgtgaggctatcccatgaccagggcccccaggagtgactcactctaatgctggtctgccctcagtttccagaaattcatcacatttactatttaaatgttcctgctaacttacggtgtctagcatcttcatttaaatgttcttactaacttatggtgtctagcatcttctgctccaagtaaacaattctttctgtactgtatctctctgaaggagtctgttgctgcagacttttttctttttttagaagaattataactttattttatttatttatttttttaaattatactttaagttctagggtacatgtgcgcaacatgcaggtttgttgcataggtatacatgtgccatgttggtttgctgcatccatcaacctgtcacctacattaggtatttctcctaatgctatccctcccccagctccccaccccgcaacaggccccagtgtgtgatggtcccctccctgtgtccatgtgttctcattgttcaactcccacttatgagtgaaaacatgcggtgtttggttttctgtccttgtgatagtttgctgagaatgatggtttccagcttcatccatgtccctgaaaaggacatgaactcatccttgttttatggctgcatactattctatggtatatatgtgccacattttctttatccagtctattattgatggacatttgggtcggttccaagtctttgctattgtgaatagtgccacaataaacatgcatgtgcatgtgtctatagtgttgctacagatttgaaaatgatatgttgacctatgacttcagttctctgatgggtagaagaaaagtcattgaattttggtttgtccagatttttcttgctgtaacaaagatttccaagtgatgacttaaaaagagtgatgacttcaaaagagtgatgacttctaagttctttgcatattggaaataaaagtggaagtctcagctcttctaatctgtgagaatgttagcaagttactaaatctctatgtgcattagtttttatcatctgaaaaaatgggtataagatgccttacctaatgaagttgctacaggggataacttctaaaaaacatctactgcaaagtctggtatgaagtaggggctcagtcagtgctatttgtctaataaaacacgcatgtattcatttcctagggctgtcataaaaattattgcaaacttggtggattaataaacaggagtttattctctcagaattctggagtctagtagtccaaaatcaagatgttgacagggtcatactcccttcaaaagctcttgggaataccctccttgccttttccagcttctagtggctgcagacattccctatggctacataactcccatctctgcctcagtcttcacatggctttctctgtcttctccttctaagatttatggcccacccagataatctaggaagatctcatcttgagatccttaacttaattccatctgcaaagatagaattttccaaataggtcacattcacaggttctcaaaattaggacatgaacatatttttttcttttttgagggaaagaccattcaatcttctataatgtattagttaagtcagctgttgactgaaccaaactatcagtttggccaaacaattaatcttaaagttccatataaacttctatattgccctagaagaatagagagtagtgttttaatttctttgtccaatagaatagattccacaatacaaccatcagtgccagacagtcaagaaaacatgatctactgtatcaacttactgtttttccttcaaggggatcacaatattttatccacaaaagcaatttgggatcattcctttgaatagagaggaagcaaataatatggttcttatgttgtaaatgggaaattaagacagaagggtaatccagttaatgtttatggtttaattaaaaatgctgacagaaagactcacgacattggtagaacttcttattagtgttgtcaacatagctgtactgcctcatcttcttattttctttctcaaatttcaatctccagaaccaaagaagctctattttgcatgcatcagtaacaatgagcaatttacacttagcgatcctcctctgtcacacaacagcagctgtctgtgagtcctcattctactgtgagaagcaggtttgctgttttattcctctcttattcagtgcatatgcaaggggtggggtggagggctgggtacagaggacagcaaggagacaataatttatcatttccaaacaaacaacaaaggttgtttcaaaaatccagcttactgtttttattttcagtctgtaattcattttcaaaatgtttggacataaccctttggctttgcttctgagcatttacatgacatttagacagtgaacacatctccgattggtgcacagctatgggcatatggcacagcttactggaaacacggattcacaagaatacgtatccagtttcagaataagaaccaagtatttgctgactgagtgtcatgtggactgttttaaactccctatccataactttcaaacctactctggggggcggtcaaggggaggaggtggaagggtagactgttggctggaatctaatgcctttcctttactattaaaaatctatgtgaaaacattcctaatgggtatggtaatataccactttcgtaccttataaaaacctatttacttagtttactcagtttacaagctgagatttgaagcactaaccactcggggtcctatcttgatagccctggcttacttaccaatataggagaatgtgttctgttcaacctgagaaaaatggtgggagaggaccagcagttgaacacctggcccatctaaagtgaggatggtaagaatgataaaggaaggtgaccagttgcctcctgggttctctgatcactgcatgtttagctgtgcggttaagacagcagatttaaacgcaatacagggtcctacgatgacaatattatctgccattgattgaaaactgattatatacaagggggttactattcaaaacctcattattccttataatagccctattaggtaggccttttcaatctcacatcatgtattaaaaccacctttgcaaaaattataactgataaaattattacagtgaaagaggtctgacctaaccaacttggtcttgcttttaacctccaagctgtccttgttcattcctgggtgtagagtgaactaactttgggagcaacgcagtttagagtttaactttgaaacataaaataacagtcctttcccgcaaccaaccctcttcttgcctttgttagactgcctttgcagtactaacaaattagccagaagactagaaattatagtttaggagtcactgttgtaaaacctgagattagtgtttgagatactttgcagagtctacattctaatgcaccagctgatgccacccagatctataaactgcctcatctggtcttatggcccccatccaggaactgactcagcgcaagaagacagctttgactccctatgatctcatctttgacctgtccaatcagcactcccgactttctgacaccctacccaccaaattatccttaaaaaccctgatccctgagttttcaggaaaattgattagaatattaactccatctccaacatggcgtggccagcatcgtgacacttaagctcttcctttactgtaatgccatggtcttagtgagctgattttgtttgtgcagtgggcaggaagaacccattgggtagttgcaatatgatcaaagtgaggcttaaaaggttaggtaacttgctggtggcctcactaaacctcactaactccatgctccctaccatggagataccactactaataattaataataactaataacaactattgttgttaaaatgatactgggtaaaatcatgtaaaataacaactatgagatatagttgttataatgattaaataggtaaaattgtgtagaataacaactacagatatagttgttatagttaaatgaataaaatcatgtaaaatttacaatcgtgtaaaataacaactatgagatatagttgtcataatgattaaatgggtaaaatcgtgtaaaatgctgaccaaaacagccttaacattttcctcagtttgactaaactttagttcagcttcttctggactcaggcccctgaactcccttgttttagagcgcttactttagaaaactcgtagatgtacattttctctctgctcctttaggtgtaaatctttttaaaagcctcttgccagttttgtaacccagcactgtccttctcaaggacctgagaaccattcctttgaaaagtcatcatcaatgaagacagtgcttcccagtctcccagggagggcacaggcttaaattgtcctagttgtaaaactacctcctgtcacaaagatatgagaaaattaactttgttttgggatcacgccaattggcaaacatggatgccctgtgatacgccccactccagttcttgaaactctaaaaactctaccatcctttattccttgagctctgtcttaattctgatttatcttccctaatgcaatagccttaaataacatcttccttgcctgtttacattgtcgagtgccatttttgtttttacaatgcttttcatattgattgattgattgattgattgatcaagatgtagtttcactcttgttgcccaggctgcagtgcaatggcgcgatcttggctcactgcaacctcagcctcctgggttcaagagattctcctgcctccacctcccgagtagttgggattacaggcatgcgccaccatgcccggctaattttgtatttttagtagagaggggtttctccatgttggtcaggttggtctcgaactcctgactcaggtgtggtcgacctcctgcctgccttggcctcccaaaattgttgggattacaggcatgagccaacacatccggctgacaatgctttttaataactgtttcaaagatgagaaaacagaagaacaaagaaataagctaatttatccaggactgtaacccaggccacctagctttggcggtcatgtctgaatcatcatacttcaaagggaaataatatattcacacagtgataaggaggcatgtgaagcctagcaccttcacttaacaggtgctcaaaagctggaagctgtgataatggagaggaaggaggaaaacaggactcaggacaagcagatctattttggatccaggcaatacctcttagtaatcctgtatccttgggagatcacagtaatagtacctgagatttgtgcttatgctatttccctgcagctgaatggaagtacaagtgttctcattgcctaggtgggttttgcacccactcttgattatccagcaggaagcacaaacatctttgaaggatgatgagctagtataccagtgacattctggaataatatctcattatattattattaagggcaagaaagaaatgtgaattgactcttttaaagacaatcaaatcaaatataaatgtcattaaatagacttaaggacgccgaatggaagaataaattatggagcagaaagtcaaggttagtcacagaaactaacaaacatagggagaacaaaggaaattgtggagagagatgtatattgatgctcaaaaagacactgcagatcattgatttgaaatgcttatgtattaatattaactggggataattcaggcctgttttgtattgtacccagattagaaaagcagatgtgattctcccacccctttatcaagaacgagagtaagtcaaagagattgctgattgcaaattaaaatgttaatttctatccattttaatttttgataaattcttattgagagctactaattttagaaactttcaagtaccgtaatagctttcagtctattgagtccctgggaatttgcctttggggccaattgctttctgcctccattatgaagaaatattaaatgctatcaggaagcgcaaaagccacccttggtagagagacaaatttcaatttatgaaaggcaaagtattttaggttatgtaatatgctctccagtgcaaacaaggagttgaggatactagctttcaaggaaagtacaaaatacacaatggtgttgaacaggacaggtcagtggttagcagaagtagtggcagcaacatcagtagaggggtagtgtggtaattagatagtgctatctaagctttactgaatgcttattaagttcttatcacagatccatgggctttatatgtattaggcattttaatccttacaaaaattattttagatattatcattatctctggtctacagccagggaatataaaacaaagagaagttcagtcatttgtccaaggtcacagagctgagaagctgagatctgaagccacattgtgaccaccacctccagattcaagctctaactacttggcatgcctactgcctaggggctgtgcagggagcttttcatattccacattgctgagaactgatgaaactaaatatgggggagggaagattgtctttttgctttatctatgcctcaagaaccacagagatgaaacatgtacaaaaatgggaaattctagaagctttttttttttaatgaaggatattacagttcataagaacaaagctatcacaggaatcattttcaatggattcagttacctgatgaaggtactgaagggaaatgcagaatccaaattatctaacagataattcacaaaatatgattgacagtggactcactttctggaagttagagcaggctggtgctaaactgaatcataatggaatgatatattccctcaggtgaaatacagtctaaatcttcatgctgttcgtgcagcacatagcattaatagaacatagtaatgtggacatactttctaaagcagcaatacaaatgtatattggcaaattgtctctttaatatattgtttaacttctccatagcactcaacacaatgtgtataattaactgagcaattatttatttagtgcctgcttccagcactggaatacaagctctgcatggtcagcaactacacatttttcttattatattttgccttcccagtgtctagtggtgtgcctcacacacagagggaactcggtaacatttgttgactgaataaatgtaaggtattttctacataatgcagacttgttaatttattctgctattaataatttattgccgggtgcggtgactcctgcctgtatttccagaactttgggaagccgaggcgggtggatcacctgaggtcaggggttagagaccagcctggtccaacatggtgaaaccctgtctctactaaaaatacaaaaattagccagacatggttgcacatgcctgtaattccagctactcgggaggctgaggcacaagaatcgcttgaacctgggaggcggacgttgcagtgagccgagatcgcgccactgcactccagtctgtgtgacagagtgagactctgtctcaaaaaaaaaaaaattattgagtgctgtttatctgccaggcactacactgggcactggacagctaacagtgagccaggcaggaagggccatgctctgggggtacttacattacagtaagagagagacacaaccttgagcaatgcataaataaaatcattctagatattgttaagtactgtgtgaaaatcaaagagtctggtgagtgagagggactacttggtgagcggggtttggggcatccaatgttaaactaagtgggcttagaggatctctctgagtgatcataagacatccatgatgtcttcaaaggaatcaaaggaaagggttttgtacgcgtaagaaatggtaagaggagaggtactgaggctagaatgagcttggcatgttttaagaaaaaacaaggttccagcctcagcaacataaaaagaccccatctctaccagaaattaaaaaaaaaaaaaaaaattagccaggcggggtggtacgtgcctgtagttccagatgctcaggaggctgaggcaggaagatcacttgagcccagaagttccagtctgcagttagctatgattatgtcattgtactccagcctgggtggcagaatgagaccctgtctcaaacaaatacaaaagaaaagaagaaaaaaaaaaagaaggttcatgtggagtgtggtggcagggagtggggagggaaactggaggagaaacttgggaagtgagcagagattctgtaataagatcctgtaataagatcctataataagaaagattcataataagaaattcgttttaattctaactgcagtaggaagttggtgagtgatcttaagtaggggaataatgtgatgtgatttgcatttttaaaagatgactttggctgctgtgtggagaatggcttgaggaagaagaatgaaagccaggagacccactgctgcccagggtgcgtggtatatgtactccaggggaaagatgctggtggcttagcctagcgtgatgaaaagggagatgagaatgagcctggttttgagattcttctagtgacagaaccaataggacttgatgatgggtgaagcgagggaaagagagacagatggaggagagcctaggtttgtatttttacaactgcatgagaggaggagccggcagttgagaaggagaagtatggaggaaaaacaggtggagagaatgggaatcaagaattgggttttgtggaacttaaatttgaaacacatattagataaccaagtagaaatgtctagtgtgtaggagaatatagaaatactgaagtaactagcatctagatggcatttgaagctacaggattatactacctgtgacaggaaatatgtgatttattaatttagtgcaagtgtaggctagctggctcgttttgaattaagatgagaggaaatagctttaccttgtggaaccactggagagaaacgtgtatcagctctatgagcatgattactgggcatcagccatgttgagtgctggacttcagaaaatgaagatcgggacagcagaggaccaagaagccagtgatgttcactaagcaggcaccagccttccctccctttcaacgtttggatgttgtagttacataaattcctggccacatagactcaaccatagagttctcaagaggatgccgatggatagagttttgaattggattgggaatccaaatcaaaagtacaagaaatctgcttgtgaattgaatttacctgacagtgtcaacattaagttgtctgctaggaaagagtttggaactcatattcagtttgtagaaatacatacaattatagcttgtgcctatccaaagctttactgttgcaatggtattatgcagtgagggaggacacagaggtagagacaagacgcacagtacacagccccaggccactgggttcacttcatcattagtttttgttggagaaagagactgagatgccggtgaaacagggaggaggagagccaggagagcacgggatgaaagaagcccatcaaagaacgtgtttcagctgaaagatgctgctgaagaggcaggcaagatgcaggcagagcaatggagatcagcgagggcccagggaggcgcagggactggagctgagggcacagacacccttaggataagttgaaaagcaaaggacaagtcgagacacaaaataatcagcaacaatattcttatgcttgagaggatcaccatctgggtagtgaggcaggatgagctacatcataatgacataaatcataaaaccgatgcgacgatgactaccaaggccacctgttgacacagaagacccaaagggaatgcgaactggggcagccagaaagggcttcaaaagatactgtgttcctatttcgaagaaactaagaataagatgaatggtgagaggaagaaaggatgttccagccaagagattggaccaacgtgggcaggcgggagaaatcaatacgattgaagaggcgaaaatcaaagggacaaagagatttctggaggctggctcggtagggttgtaggttgaggctgttgatgtaaaaaagaaaaacaaaacaaaaacagaaactagaggaagtcactctataaagcagaacaaatccaagaatttcctgacacaaaattaccatggggggagggggagggaagtagccatctagcaaaatacattacacccactttcttttagcttcaggcacagccaccaatacttattttcagcacccttttataaaaatttaaaaccccatgtaattatattcattcattttaaacataacccctcgaaatctagctttgtatttaaaaagaaaatctgacgtggggtttggaatcatggttatagatgaatttggtgacaagtcaaacattttggaaatgagtttccacacatctgctaaagaaccttttgttgccctttgagcagaatattctgggtgtagtgacatgtgcaaaataagaaatttaatatttttaagccttcaagatgaatgttacaacatctgaacaagaataaatgccatgcttattcaattaccttgcatcccagggtcttatttaccatcagctttctcagcatgccgatctatttactgctaaattgaataattccgcctaaaggagataacatactcttactgacagcttgtccctaaactcccagatttcacaacatcagtacacaaatatacaatatagaaatggttgcttatgtgcattagatctgatgtaaacaacagctgccaaaaagactgaattagcctgatcttatttcatttctcttcttatttcatttcttttcagtgatatttgcctttttaaaaataatcagttgtggcaatacgtgaagcggagaggcacagataacaggcacctccattacaccaatgacggttctgcagtttttcctaaagtctttctagaatgacgcacaacacattatagcttccgtgtttgctcaagattatttgattaaactattacactgagagtaaagattactctttttaggttgtcactttctcactgatgcttggcaatttacttaagggaataagctaggtgtaggtttgcaccccttgctctatcaagacaatggcaaatattgattggtagtaagtaaggcttagacgtggtttcctttttcttttacatcagccgtgggctgttgagatacaataggtgcagccaaaactgactgataaatatggatttctaccctcccacagggcttggaataatgattgagttgctttgttttttccagaacttatagcatatatatatatacatacacacatacatacacacacacactatatacacatatatttataaaatatataaatatatatgtgcaatatatatacacatatacaaacatatatgcatggtatgtatatagatgtacacacacacacacacacacacacacacacatccttctttgatggctccacttcccatccaattgctcaatcccaaatctggaattgccttgacctatctctcttttcctctgttactcaaagaaatcttaaaacttggctcattctcatctctcctgtcgaccattctagtctcagccactatcatctctcccctggactataccactgcaatctgggaaccagtgggtttcctggcttccattcttcctcctcaagcttttctctgtatagcagctgaagtaatcatttaaaaatactcctcttaaaaaaatcctccccacatggtattacacatggaaactgacagtccaaggctgtgatcaggcgatggtaggctcaactgggccagtccaagtgacatccctttgaaaggagcatagggagtgccctgccccaaaacaccccccaacacaaaacattcagcaacttcttttaaaaattatttgtataaatttagggagtacaagtgcagttttgttacatggatatattgcatagtggtgaagccccggcttttagtagaaccatcactcaaattaggtacattgtactcattaagtaatttctcatccttcactccccttcctgcttcctcccacccttccgagtcttcaatgtctatgaattctatagtcttgtcttcacactgttttgctcctacttacaagtgagaacatgtggcatttgacttcctatttctgagttatttcacttaagacaatggcctccagttccatctgtgctgctgtaaaagacattattttattatatatttttatggaccagtagtattctgttgtatatattatagtataccatattttctttctccagtcattccttgatagatgcttaggttgattacatatctttgctgttgtgaattgtgctgtgataaacatacaagtgcaggtatcgtttttatatagtgatttcttttcctttgggtagatgctcagtattgggattgctggatcaaatggtagttttattttttagtactttgaaaaatctccatactgttttccatagaagtactaatttgcatttccacccacattgtataaacgttcctttttctccacatcctcgccaacatctcttatttttttgactttttataatagccattcagactggtgtaagatgatatcttattgtggttttcatttgcatttatctgataattggtgatgtctagcattttttcacatgcttgttggccatttttatgtcttcttttgaaaaatgtctgtttgtgccctctgcccactttttaatggggttatttgttttctttgtcatcgttgattatttaagttcctcgtagattctagatattagtgctttgtcacatagtttgcaaatactttcttctattcttcaggctgtctgttcactctgttgattatctctttttctatgcagaagtttcttagtttaaatgaatctcatttgtccaaaatagtttttgttacttgtgcttttgaggtctcagtcatgaattctttgcctacggcaatatccagaagagttttccccaggtttacttctagtatttctatagtttcaggtcttacatttaagtctttaatctatcttgaagtgacttttgtatatggtgaaagatagagatccagtttcatcctcttgcatttggcaaccaaattttctagcaccatttattgaatagggtgtcctttctccagtgcataagtttgtcaacttagtctaagatcagttgactgcatgtatgtagctttatttctgggttctctactctgttccattgacctatgtgtctatttttataccagtaccgtgctgttttgattattgtatccttgcagtataatttgaaatcaggtaacagtgatgcctccagctttgttctttttgcttaggattaaatttggctatttgggttcttttttggttccatatgaattttagaattgttttttctaattctgtggaaaataatgttgggattttgataggaattgcattgaatctgtagattgctttgttaagtatggtcatttaaacaatattgattcttccgatctatgagcatgggatagtttttcatttgtttgtgtcatttacttgtgtcaatttctttcatcagtgttttgtaatttccctctcagagatctttcacgtccttcgttacatatattcctatttattttattttgtagttattgtaaatcagattgacttcttcatgggttctcaacttcatcattatttgtgtatacaaatgctactgatttttgcatgttgattttgtgttctgcaactttacttaattcattgatacaatcaaatagtcttttggaggagtctttaggattttataggtataagatcatattgtcagcaagcagagataatttgatttcctcttttccaatttggatgcgttttattttttttctcttgactgactgctctggctaggacttgcagtattgtattgatgaattcttcttacggaaaagtggaagttctgctatatcaaaaagaaaagggggctgggtgcggtagctcacgcctgcaaccccagcactttggaaggctggacagatcatttgaggtcaggagttcgagaccagcctggccaacatggtgaaaccccatctctactaaaaatacaaaaattaactgggcgtgatggtgcacacctgtggtcccacctacccaggaggctgaggcaggagaatctcttgaacccaggaggtggaggttgcagtgagccaagattgccccactgcactccagcctgggtgacagagcgagagtccatctaaaaaaaagctggctgggggagcgggggaggaaagttccataggcaaaaacaataagtctctattatatattcatgatgaaattctcattggtccaaaatgaaatgaaaaatataaaaatgatatattaaaatttttatacaattcattatgagtttttatattttatataaaaatgatattttgaaaatttttatgaggctaaatagggttaatttttaaatatttattttttactgccctttactattcttttttagttttggtgataaaatgtcctttcatttaatatgttatggtgatatcagtttacagttatctttttatgtctttacttggcaaagttaggttaacaactctatgacggtttcctaatatattgtttaaatttatttgttcacaatatccaaacctttgggaatccttaatctagagcacattttaccaaagtgccacctaaattgcagttggaattgcttgcaagaaagaagggtgggagaagtttactgtcgaatatactcaggatgctgagataagaaacttaaaaaaaaaaggaaccttaccacagaacttctcacagccttaaacatgctgatgtagatggtgaatccccaaaatgaagatacagtatacagcatatcccacaattatttgaccaaggaactcttgcacgaagaagcatcttagagacttgtcctggaaagtgttaatctagagactcacaaaatacttcaacaaatattgaatattggctggcaaatagaaatgcataatgacacttctatagaaagaggaatccaagggacataaaagaaattaagatgagaattcagagatttgtgccatgtcatcctcgactacagccttagtattttcaacttactggtttcttagcttggtctgcatatttgtgaaagaataagccccattcatacgcttatattttcccaaatgactttgaaatgtcaagccattgtatgaatttgaaacggcatctttagacctttactgaagttatgttactgttgccggagtaactaacaagtatcacagggcaggggaaggcagaaaaatatcctttcatttatcaagcactgaataaagcaagaggcttagaaatgtgcgatggaacacgatgttacaaagctattgttcctgtacctgtaaataaaaggtaacaaggtccatttgatgacaaagagtcatgagacagctacacagctcctcttcaaaaggaaacaataaaaacttttaaaaataccaaataacattacacttcttgctctaaaagtatgctggttatataacagaatgcaagtagatttataattagcacttgtttatagatgtcttatactgtgtcatgcatggaggggcaaaagaggttctgatggctattcattcagatagaagttatcgaggccataggaagtgagagcgccatcatactaatgttaaatagactgaacaatgggaaatttacaaccagcacaaggatgaatcagttgatgaatatcacattgttgatagaaaacgattttgagagagtggagcaaaacttatttaggaagttagaggcatctctcctattctcttcttccaaccctccacttcttctcgtatttaagattaatagataattagggtagaatggatgctctttaaaagagaaagcactgaacaggagagattgtgaaggttttttcatgctgtggactcaggatgcaagaggggctgtaactctcaggatacaatgagaagaggcatcatcctttctggggtaacatttggcagtatagagctagaatagcaacattaagggtagcaagattaacagcaagaatacagggatcagaaagtctgaagctcgaaaatgctctgaaatcaagtgaagtgatgtaaagggaatatctaagttcatttctataatttctaggccagatagtttgttaaaatatggaagaatgcagggatgcaaaatttctccaggtatataaacagcataaggaagtaaaaaaaaaatatagtactctgagataatttcaaggaaacatctataggaattcggagaagggaacatcatttctggttgggataattatgaaacatttcggaactgggatatagctcaaaatacactcaaaataattatgtggtgggctttctcgatgacatctctcagagtggctgagaattctaaggtgtgtcaaaattctgtactaaaatttatggccaaatcaacttatttgatcaccaatactgccattgccatcagcatcaccattaccaccccaacactgctatcaccatcattactaccaccacttccacccttatcagcaccactatcaccattatctccagcaccaccacctccatcaccatgaccatcattatcatcatcattacagctaacagttatcgaatgcttactgtatgcttaacaccattctaacccctttacatgaataagcaaatgtaagctttcttcaaaattccaggtgaaatgctattttctctggatatgccccacttcgttgaattatcttcccttcaatgaaattttctctttctctgtaaagttctttaatggaaaaatcactttccacattatactatagatgtaagttacttatttcccttctttaaggacagattatgcctgattccacttcaagcctctcaaagtacccagcccactccttactactaattgctcaataaacttatttgtgttaaggaacaaataaaaagataattcctacggatacaatatttttaagattgactctcattttggaatacaaacatgacattgtatacaaagcaagagtttagttaccttcatccatgtcaaactatgtctttaaaattcacagaaaataaaagaaagacaagttacacataaaccttatgtcagttgtgatgcaaaaatatcagatgatcatttacacattgaaagaaacacaagtatagaatagttgcattatcaaatatttctacaaaatattattgatttataacagattttattcataagtcctgccactgctggtataaaggcaaagaaatatcatgtaggaaatatttcggctgcagttgttggttgcttgctgtggtggtggttgttggccttagctacatttattacatccaaaatatagagcagcgccaagatctgtctaagtcccatgcttacacaattagcatgcttctcattctaaaaatacctttgtccagtgctgtttgagaaaccagcagagtttttctaataatcttgttaaattacatgataagtaatccattgcttcaccttacaaagggatagttaggaacaaggattagatggtttgcctaagtatgttgtagtagagactagctgaaactatcttcttggatgcataggctgcatatgcctagcttgccgtgcagttagatggggccacatgactgagtaccagccaatgtaaggtgaacagaaatgtttagtccttctctataaaaaacctccaaggtgtcaacctccagttatttttgcctgttgcactccactaacaagaatggtgattgtgggagctacatacttaagttgaaaggacccacaagatgaaaaaagcttgagcccctgagtcacaacctggaagagaactgactagggacataggtttaagactttatatgagtaagaaatatgcttctgtcataataaatcattatgatttgaggatttatctgttaaagtagctaaggtatattaactaacatggacattattatcttgaagtggaatgttgctctaataaaagccttcaataggcttagtcgttatggagtacacggctaggaaatacgtatcagaagctggtaagatagagatgtgttatttggagacaaaacatttgttaagtctatcatctgcaatacatgttcctacatgtattgaccaactaaatcttcaattagcctctaactctgggagaagtaggtagggaaagttagaatatctgtttgtatgcatatttataacagcataattcacaattgcaaaaatatggaaacaacctaaaatgcccatcaatcaacaaatggaggccgggcccagtggctcatgcctgtaatcccagcactttgggaggccgaggcgggcagatcacaaggtcaggagttcgagagcagcctgaccaacatggtgaaaccccatctctactaaaaatacaaaaaaattagccaggtgtggtggcaggcccttgcaatcccatctaattgggtggctgaggcaggagaatctcctgagcccaggacgtggaggttgcagtgagccgagatcacgccattgcacttcagcctgggcaatagagtgagactccatctcaaaaaaaaaaaaaaaagtggatacagaaaatgtggtatatgtacaccgtggaacactactcagccataaaacagaacgaaataatgacttttgcagcaaattggatggagtcagaggccattattttaagtgaagtaactcaagaatggaaaaccaaatattgtatgttctcacttataagtaagggctaagttatgagcacacaaaagcataagaataatacagtggactttggggacatgggaggaggtgggattgaaggataaaagacagcattttgggtacagtgtatactgctcaggtataatgggtataccaaaatctcagaaatcacaactaaagaacatattaatgtaataaaatgtaataaccacctgcttcccaaaaactattaaaatcttttttaaaaaaatcagtgtgtatttgttacagttggctgctgttggtatgttattgccataaaaatagataaacgaaaaataaagatgttcttaggaaagaattggctacttctctagctgagttagaagtgattggagatcaagccccttgtagggttagaaaatccagactgtttatatatatcaaatagcaaatagtatcttggagtaaaaagatatttcagttgaaagaaatgattcagccctgcaacaaagactcatttaaaaacgttaccttcccactcaagcttgtactttcacaaggccacaacatatccataattatgttgagaaagaagcactgggcaaaagaagcaatgaaagcagatttgacaagtatagttaatagaaagtttgggtataattgctgacatagggagctgactgaaagaacaaacatcagaaattcctaagttcttgagacaattatgctgtcagaaaatccctgagcctggattttgccaaagcagttgacttcttgaactctaagacaacacttaggtctgccaatttgtaccagcctgagaagtgggcaatgaacgtagggtagccagcctgatccactcatgcctgtgatcctagcactttgggaagccaaggtgggaggactgcttaagaccagcctgggcaatacagcgagaacctgtttctacaaaaataaaaaattagtagggcatgcatttgtagtcctagctacccagaaggctgaggcaggagaatcacttgagctcaggagtttaagggtgcagtgagctgtgatcgcaccattgcacttcagcctgggagacagagcaagatcctgttgaaaagaaatagaaagaaaaaaaagaaaaggaaaagaaaaaagaatgaaagtcaggcagctcgtcaaggagagaatgtaccacaatgcccacttccgatgttgtgaccacagagaaggacagacaaaagaatacatctgtgtgtgaagatctaatcaacagatttcccccatttctgaagttgacacattcaggacacctgcccagcaagaatctgtagttgcattggtccagggaatgctgtctgcctcccattcttcacttttcctaattggaatttattagtgtgcttaacctttctctactgtgggatcaaacactgggcatgaggtgtgggttgtgaggagagggtaactaactggtccttctgttcatagataaaccacaaggcgccatatctcgttctgacagatggctgcacatcactggaaggatcttattcgttgaatcagacacagaagcagaatgggatttggggttgtctttggcacatgggtggtttataggtgtgttctatgtgtgagaagaaaaatgaaacagatatatggaaaccagaaggtagatttagaagagattggtcagttgatcactgaactcatttcttttttttttttcccccttggcatgcagcaagacagaatttctcatgctccttcacagttagttgtgatgtacaaccgagtttcaacacttggaagtaagtgaaatgaaatgggctgctttctaggcctggataggaaaatcccctgcccacgattctccatgctctttccccatttagcttgatgcaaacaagccagagaccttgaaggctagctggtgacgatggcagagccataacatggaaggatgtttgatctatgaatcgccacttggagaaccgacttgctgttcaggaacacccgctttggaaattacatgttcaataaataaacctgtgttaagacactaagattcagggactttgctgttagagttgatgggattaccttaaccacacacccacaactggtttaatagaagattgaatgtaaaatgatttcaagtgcccaacggctgaatttcttaatatgctatcctaagtctcatcatgatgatacactaggaatgacagaaatcagtcatatggactctttaagacagtttttccctgcaggaaaactgtgaagagtatcacctgaggtggccacatctcctttagacccctctcagcctttcagcgttttctgtaaataaagtccattcttcagaaaactttcaactaaactttgatgagatagagccaccagaaaagaaaaatcatgtatgctgtaaccactagaccaaggttcttttccaaagaggtttgtcgattttgataaatgtacttctaaatatatttgacatacataggcatcgggtgtttaatgaacagctttttctgctaaacgtcattttttccaaggttctcttacaaggagcttgacatgtgtagatgattatgagaatatatgtagactcactttttacttttctttttatttatttatttatttacttatttatttatttatttaagactgagtttcgctcttgttgcccaggctggagtgcagtggcgcgatctcggctcactgcaacctctgcctcccaggttcaagtgattctcctgcctcagcctcccaagtagctgggattacaccatacccggctaattttgtatttttagtagagacagggttttaccatcttggccgtgctggtcttgaactcccaacctcaggtgatccgcccacctcggcctcccaaggtgctgggattacaggcgggagccactgcacccaggcttctttacttaaaaacaaacaaacaaacaaacgaaaagctttctattctcagaagtgttcttgccctggctattataaattttccctgttctatctaaccaacagaatgtattactcttccctgggaacatgcacgtgcaactccctctcatgtaaaaattgccatattatccaagaagagtgtgtacgggtgcataattcaattaaatatgtagttcagaagcaaaagtaaatataagattgtgctaaggttcatgaattcaaagtttaaatactgagactctcagaaaatgtaaaatgcttttaaatgtatatatttattctgattattaccttttgaaaatgaactgaaaaaagacctacttaggaaacagaaatacttctgagatattgataagcggcttattatttttattgcttcaatttttagttttatgaattactctccaccacaacatattactggaaagttaagttttactgcggtgatctttcactaaagtctaattcattctaatcatttcaaaattcagagtttggtgttccatatttttgtcttccttgtcagttcattttgtatattatttacttgataagctgaggcttgaaaaaaatactcgcaaaagcttgtctgtacttatggccctgggcaggagtacaggcactttctctcatgagtattttacataggaatgatccagagaagagatgtggccctgtctctaccttgacagtaagctccaaatgctgacatttgctgaagtaaaaattctccctgtctagtggcaaaggtgcccccattcctttgaccccaaaactcccacttcccccaatcttcccatgcagatgttgtctgcagaaatgaagccatcaggcatcagaccccaaagcagacttaggtcgcatttacacattttctatcacaagcaggataaagacagactcaagttacccattacatttaggacttggggctcttagcacccaggctcagggttttaactcaggacacttacaatgaactaactcagtactacctttggtagtactacctttgagaactaggttccctgctagactttgaatttcttgaggattgggggcacatcttatttgttgttgtgtccctggaacctaccaagtactagagcatcgtgggctggctgtaaatgtctgtgggatgacttagtaaatgaggaaggcgagacatccttgaccaaccatagtgactaagatactgcagtggaacacctgctgttcctagttaactaagtaaatatggatctcccatagtatatagagaaagaataactctaaggaagaaggggataatggctgcgattccttccaaaagaacgctgtcacatgtgtgggggcgctgtacatatgtatcatctcttaactacaatctatgcatgtagtttgtttacagagatatttcatgcatgctgtagaaaattcaggtcatataaaaagggattataataaagctaaaatcccctaaaagttcaccactcagaagaactctcccatcaacatttgtatggggatcacccaaggtcaatctttctgggtatgtctgtgtttatgcttcctataatttattttgatttatgtttttgctgtatcacttctgcttctcaccctttatgacatgatggagatatgtctcttttttattttactagtagtcacttttataactttaaatagcatattttaacaaagttcttaatatattaagtacagacataaaataatacatacagaaaaaaaggcacataaaagaccaggaatagcttactttctctcatcttcattttattggagcatgcttcaagattatgtcccttggccgggccgggcttggccgggcgtagtggctcacacctgtaatcccagcactttgggaggccagggcaggcagatcacctgtggtcaggagtttgagtctagcttggccaagatggtgaaaccgtgtctctactaaaaatacaaaaattagccgggcatggtagcacatgcctgtaatcccagctacttgggaggctgaggcaggagaatcttttgaacctgggaggcggaggttgcagtgagccgagatcacagtgagccgagattgcaccattgcactccagcctgggtgacaaagcgatactccgtctcaaaaaaaaaaaaaaaaggattatgtccctttatcctagtgtaattattattactttatattgtatggtatacttgctttcttttgtacagccaatatttccaatagatattgtgaataattgtttgctcaaatgactttaatctcattactagtccactcattctacacgagtttttgaaattattatcactttccagttcagtagggtatatctgatctatttcctgagtctttaaaatgttctgaatctttgaatatttattcatatatttctattttctttttatatgagctataacttaactggttatataatacttttgttacactattttgtctcaaattgtgtagctgttgcttcattgtctttgggacacaatgctgctaaggaaaaagtctggatccaggctaatttttttctctatgatattgttgaccctatattgttactttgtatttttgttatttgcatttttcgttgttgtgttcttattttttccccaatattttcaatctatggttggttgaaacccgctaatatggagggtcaactatgatatgatattaatacatatatagatatatcatatataatattatatagttatattttatatattatattagttatattttatatattataatattatatagttatattttatataatacatattataatacatagttatatttatataatattatgttatatctatatatagatatgagaaaaagcaaaaaacaagaacaattaaaaaatataaatacaaaaacccagtagagtataacaactatttatgtagtatttacattgtgttaggcattataagtaatctagagatgttttaatgtataagggaggatgtgtgtaggttatccacatatattatgccattttataaaaaggacttgagcatccacggatattggtatcgaccagggtcctagaaccaatcctgtgcagatactgagggatgatgtatattcttttgcatgtatgcttgtagaaatatttctaaatccttgcatttcaacaacctactacaatctttgtgctacttgctttgtgatacacatgcttagaacatcttgcctcatcttgatctgcagatttgggtttgaattaatttctttctttttgttttttttgttttttttttttttggtttgagatggagtcttactctgttgcccagggtggagtgcagtggcatgatctgggctcactgcaaccccgcctcctgggttcaagcgattcttgtgcctcagcctcccaaatagctgggattacaagtgcacacaaccacgcccgcctaatttttgtatttttagaaacggggtttcaccaaattggccaggctggtctcaaactcccgacctcaagtgatctgcccgccttggcctctcaaagtgttgggaatacaggcatgagctaccgtgccctgccctgaattcattcgtttgtttgtttggtttttaagacaaagtctcattttgtttccctggctggagtgcagtggcacaatcatagctcactgtaacctcaaattcctaggctcaggcaatcctcccatctcatccttttgagtaagtgagactacaggttatgccaccatgctcagctaattttaaaatttatttattttttttgtagagatagagtctcgctatattgctaaggttgatcttgaactactggcctcaagcagtcttcccacctcagccacccaaggttctgggagtacaggtggtaagccaccacacctgacttgtttctgttgttgttttgatattatcttcaggtataacaatgatccataagcttgatatttatttcgtgcctccatatctataatcttctcccttattaaataagttaacacaagaatttagagcaatgctttacacagaatatatgttcaaaatataaattattataactgattaattgttttaactcttttttccctaaactctggctgattttctcagtcttctccttcctatcactgactcagctctgtagtgctgattctgtacttcgagtttctaaagagcttttaatttccatgatggcaattactttctcttcagtttctttccttaatatggctagctgcccttaaagtgaattcacttaaattatcgtctcatctttgatctcttcattcagaacagtagatgatataccttaaattttattaaattcctccatgttggaaaacacttgtctaaaattttcttctaattccttgagtgtgctttcctccaaaatgtgttcctgaattaatcttctgcatgctagactttttttcttttaccctttggctaccttctcttttgcataaatttaacataggcaagatattttatgtctaggtgtctttgtatttacttacttatttatttatttatttttgagacagagtctcactgtgtcgcccaggctggagtgcagtggtgcgatcttggctcactgcaacctccgcctcccagattcaagagattctcctgcctcagcctctcaagtagctgggattacaggtgcccacaaccatgccaggctaatttttgtatttttagtggagacagggttttactatgttggccaggctggtcttgaattcctgatctcatgtgatcctcctgtctcagcctcccaaactgctgggattacaggcatgagccaccgcgcctggcctgtctaggtatcactgaacagtgaacgctattctacgcaggcttgccttttgcccaaacataaaatgggtggattctcattgcaactcctccttgttttcctgtaccttgcttgaaaaatctcatttgaaaaggaccaggaagtctccctgtggtttctattctctttaaagtatttcaagagagaggttttcagggaaggcaaaggggccctggagttctattcaggggattcctctcttctctcccctccatcagttggtctgaatccccagtaatatgggccagcttcacacaattgaaggtgtgccctggtctatggaaagtacctttggcatttagactttttttctctttggagtagggctgttatgcttcctgtgagatccttgtggtttatgagtttagggtttttttgtttgtttgttttgtttttcatatttcctaccaagcattttgttttctgctgagatttggggtagatccatttttcaaaaaatttcaactttatttcaggttcagtagtacatgtgcaggtttgttacgtgggtatattgcataacactgaggtttggggtacaaatgatcccatcaaccagggagtaaacacaatacctaatgggtagtttttcagccctgacccccccccccttttctagtcatccccaatgtctgttgttcccatctttatgtccatgtgtacttaatgtatagctcccacttccagaaaaccaaatactacatgttctcacttataactgagtagagccattgatcctcaaagatttgtctgtttccttagttagccaaaggggaaaagtggccaaacttttgatatcattcaagtgaaggccttgaaaaaccatttgtcttcagtggggaaaaagaactgcaagtgggttattctacatcttttcttcaacggccgacacctccattcttggtcttaacaaattttgaggataccagtcagcgatgatgagtatctgaatatatgtgactctctcatgggcaggaaaacaccctactaatctttgtacacttggtgcccaggtgctatgcatacagataaattctcccttaaagggtaatttgaatgccatatatatcatctgtagacagatgatttttctgcttgtccttagccacttaggttttgtctcttcttcttcaatctggcaatttcctatatatgaaatgtacaccagccagtagtgcaatttcaattcataaatgttacgttctactgcccatagatccccaaatgagctcatgaggaacttagagtgaagcgaaatgccagtggacctcctccaaaggcttgttcctccaacagcagcaaattttgtgagcagtccatgaaccccaagtctgagagatcagtctcagatctatctaattgcagggggctgtagagacttaaagcctgtatttattatcttaattaccttttggccagggcaaaaggagatgttatatagacaaccagttgctttgaggtttgcactgaatccacgtatctccgtagttgctcccaaccaatgatgaagcacagcccagtgactaaaatgggctatttctgggaaacataggatgctcccatggtgattttagcttcatagtttccccacagccttgctgaagttttcctggagctgtgcacaaatctaaaatacttgatccaactccctttcttttcctctttctttgtctttcccggcttcctggtatctttctttccctcccacctttcttctctctctcacttggggttagaactgaaggattacctgttaaacacgtttaaacatgcttttatgataatacagttcaaatgcttcccatatctacattataacctttattatactctctaatgtacttcagcattatgaaatacaacataacatacttcaacagggaacttgactttcaaatgtcactattagtacttactaaattgaaaggaaatgttctcctatcagcaagtaaacacgatacacttgaatattcatgccattgcaaccatgcactattcaaatcttctctgtcaaataattgtttacaatccttttttttttttttttttttttttgagatggactcttgctctgttgcccaggctggagtgcagtggcgtgatctcagctcactgcaacctccgcctcccaggttcaagcaattctcctgtctcagcccccctagtagctgggattacaagcgtgcaccaccacgcctggctaatttttgtatttttagtagagatggggtttcaccatgttagtcaggctgatcttgaactcctgacctcaggcaacccacctgccccagcctcccaaagtgctgggattataggagtgagccactgcacctggcctgtttacaattcttaattgcctgtcagtggtgtagatgtgtatgtatgtatggcggggtcacgggcattattaccaagtttaaaaggaaagagtctaaaaatagttcccatgactcaggaggaaagtgtccctgtgttgtcaccttatttccactttagatccgtctatgttcgtaaccctgggacaggatcaatgatctgtaaaccaggctcagcctccccctggtgagcctaatgaggcacagaaataaaatataaaagtaagttcaataccaaatcttataccctcctaagaaatagtaagagttggaaaaaataaatactcttttataaagagtgaaatgaatctgttttcttcatatctcccccacccctaacctttagtagaagccagcataaatctggggagagaagccctccatgagtgctgggccttccagcctctcacccacaggccatggtgtcactgtgactatagttttactaataatactatatggcggctcatttttctattcaaactctctggaagatattaaataagtctgttttatttaatagataaatcagggctgcgatgttctcaccaaccaattaagaagcccagggaaaatactgacactctccttctgaggttcctctgtgcctcctgaggatggcatatgtaaagttttctgtttccctggtcttttcatcccattcttatgcatcatatgagctttctagggttgtcatgacaatgtgccaccaactgggtggcttaaaacaacagacatttattgtctcatggttctggaagctacaggtctgagactgatgtgttaacgggaccacactgcctctgaaatctgcaagggcgatctccctgcctcttcctagattcattgggtttgctgacaattgttgacactcctcggcttgcagctgcggcacttcagtgtctcccttcattgtcacacagtgttctcccctcttctgtctgtgtcttcatctcctgtttgaataaggacacctagcttattgtattatgatccaccccggtgatctcatcttaacttcgttacatcttcaaagaccctatttccaagcaaggccacactcacaagtactagggggtagatctttaacatatcttttttggggaccagttcaacccataacactaagattgaaaacctggcaacatcgacttaaatatatttgagtgtgttagtgcaaacctggttttggtgccttttacattcaactggacattactggtgttatctcatacccctctttacagagttctgagttgtcttcgtgaattcttatttacaacatagatgcattagacacacacacaaaaactttattttgtttgaaaatccttgacctttggaatacatttaaagatgaaaagaactatgtagtcaactcaaatctctagagaccctgtagtcctcatccttttgttaaactttcctcatgactttgctacagtgggtagtcaggagaaagggctttcccctacctttaatcacaattgtctgtggacaacttttgtaatatatcccaatgttgtaggagtctcagcttgaccataaagaagatgctaatgggtatgttggacgaactgttggtgcagacccaccaggaactaagggatcttcctgtaagaagttcttgcaaggaaagatggaatttggcataatggacttctacagatatcaggctttggtcatgtaaaagctgaggagctgctgaacatctcaataagtttaatgtatctggtttgtctccaggcccttgggacagacgcatgaaatctgtggtagtcaggatgggtcacactgtactaacccaaaaaggttacagctattttataaacaccaagagatgcttgacaagacaataaaacatagaaagtactattatttgagtgccctcggtacttttctcacacctggccaagacctacactttgtagggccttttctagcttcctctagttatagccttctccagaggttaaaagttctacatagctaaggggctgtgtccaccaagcatctttgcccccaattctcgcacacactgttagaatccagaaatttccttccctaaagaacgtgatcccattatcaagaatctccaggtcccttccccaggttttttatcctgaagatagatggcacagccagtatgtgtagatcaggctcaaggggtgcctgaggggtggctattagtggggatggtgtgaatagagcttgggcatgcagactggagcatccatacacttatccaagaggctgctgggcacacaaggaaaatcctcaggtggaaagggaaacaggagtaggctagaggctggggttaggtactggaggctggctctcccaggtcactatgttccatcatgggacactgaggagtccaagaattccaaatatgaatgtggtctttcttgtaattatgaaggtaggcttgtcaaagagggaagatagtacatatattattgaacattttcttagcttgattcataactttgaagtacaagtgacccttgaaccacatgggtttgaactgcacaggtctgcttatccctggattttctcccacctctgccactcctgagacagcaacaccaacgcctcctcctcctctttctcttcctcctcctccacagcctactcaacatgaaaatgaaaaggattaaaactgttatgatgatccacttctacttaatggatagtaagtatatcttctcttccttatgactttcttaattttattttttctagtttactttattgggagaatatagtatatgatacatataacatataaaatacgtgtcaatcaaatgtttatatgattggtaaggcttctggtcaacagtaagttattagcagccaagcttttggggagtcaaaatttatttgcagatttttgatggtgagggagattggcacttctaacccccacattgttcaaaggtcaactgtaaaatcctaggttatgagggtctctacttgtactcttgccctacaaatgttaggggtgggtctgggtgcctgtccatcaaagtatatttccagaggccaggtgggagggaggcagtagctgcagatccaaggaagcacagagaaaaatagtagataagcagccaagatgagacagtggaagctcaatgaagttatgtcacttatctgtctgaaaccttaattctgccttgtcatggaaactggcatattcacaggttctggagataaggaaacagacattttggagggctgttattctctctgctacaggctttaatcacctgcaacttggttataaaaactcgtttagatgctttatcaggtagcagtgattcaaatgaattacactctgtagttaccttgaaaggaacccctgaaaaagggattgcagaagccaaccaatatagcaaagcacagacttcacgtcctagctttttgccttgacttctttatttggtcaaagaatctctctctctttctctctctccccgcaccccccaacccaccccatcactcctcttctcctctgcctttcctctccttctcttgcttaacaactgattcacactgtttaaataacttccgtgggtagagagaacttgaagtacaaaaactaaatagattttctaagtcacacaaaaaatctgagaaccaagatgcatgcatttgcttgcatcaacagataacggctaacttgcattgagtgtttctctgtctgagatactatactaagcacttgacatgtgttatcttattcactccttctaactgccttattcagtaggtgctataattattactatctcatttcacagatgaaaacactgaagcttgaagaggttaaagaacttgtccacaaccgtacacgtatcatgtggcgcagtcagtcctcaaacccagcctctatagttttgcactgagccccttcaccaccatgactgtatctaggaatccttgctaagcttccccagagatgtgaacaccttccataaacatgttatatacagcagacatgaccacagcttgttcaaatcagtagaacattttccaagagcctaacatgtattgggtcccgtgttcaatgctagggatacaaatataagtaacaaaatgcccatgcccttcagaacctcagcttcctggggaaaatggaaataggaaatgtcaacgcagcaagtgaagtgctatggtagaaggcattacagaagcccagcagaaggctgcaagcgatcaaggttgttaaggagaaaagaaacaggctaggaggggaggattaaaacatttgaggtggacgttaacagatgaatacaaataagccagatgaagagggtagggaaggtatttccagtcagggataagagcaacgtgaaggccgagcagtatgggaaggcacggcccatgcacagtgtcatgtacctatttacaccacacactactactctgaactctttgccataatacactctggaatgctgtatgccttagcttgaccttctctatttctataaaaagcgaaatcactcctccctctgatgacccatgtcaaggttgaaaaaccatctactgtatttcaaaattttctgagttgatttggccttaaggattctctaataagcctgatataattcttaacaattcccccccaaagtattgaactaatagctattccctgacgcaaagcaattttctcggaggaaatgatcttagaatttttctgcatagcgtggatgctttttttttttgacagaacactgatttctgaaaatgaatagaaagcagctgtatagctgagcttaaatgtagcccaatcatgtcatccgtgtgccagaacaagataatttttccaccctaattcccatcatcctctgcttgatttgaaagacacctacatatacttgactaagttctgggtgcttcaaaaatgtatactgtttcttcctaaaggaatatgaatttggaaggggaatcccttatcctaaagcaatcacactgaaaatatctcttgacatacatttagactttcaggaataaaatgaagattgatgtcacagtgaagtggttcaccagaatccagtaaaacttggggctaaggaaactttgcaatcaaaaaagcctatccagctcttcttgttcttagatgtccctcctcatttcttggccatgctaaacaaaatctcaactgttatctcaaatatctgaacagaggttattctgaacagacacccatgctgtagggcaagcaggcccttacaggccttgcactctttatcgtggccttgtagatctttgcttaatttgctttagtaaatattctaaatactgaccctcaaagtaggagacttttcctagagtttctcctgtggagggggaaagtcataaagctaattttggcaatttgaaaacaaaattttcatcactatcaacgaagaatatagcaaattttaataatatgacactgtgtcatttgaccacctgttaactctagatggcaaatatatttaaatgattctactttcatagatcttacttagcaataaggtgctcactattatcatcgtaagatttttggtgcaaaaagtatatactagacatctgatatggtttggctgtgtccccacccaaatctcatcttgaattgtagctcccgtaattcccacatgttgtgggagaagcccggtgggagataactgaatcaaggggggcagtttctcccaaactgttctcatggtagtgaataagtctcacaagatctgatgattttaaaaggggttttctttttgcttcgttctcattctttcttgtccgctaccatgtaagacatgtctttcaccttctgccgtgattgtgaggcctcctcagccatgtggaactagagtcccttaaacctctttttctttataaattatccagtctcgggtacgtctttatcagcagtgtaagaatgcactaatataacatctattcttctgtggtcagaagcgctctatgacctatgggtgtcacacccaataaatatgcatgaattaatggcctgacagtaataaaataagtagaatagagtccttgatctcactagatttatgatgaagttaaggaaagaacatataacactgagaattcataaacaaccccagaacagtattaaagacaactacgtgttaaactatgatagttcagcagaggagaagaccagtgtgcaacagaagagtcagagggagctacactgagagatggctttgtccaaaatgcaaatctcataacacagaaggcagccaaactcctgcgtacctccttcctcctcagacagactttaaatactttaaaggctggagtttcccagggtttgattctcatttctcttttcatctccatctccactgtctcctcaggtgatgttatccagctccatggagctcatagaatgaatgattctcagttaatgtcatggatactaatctcccatttgagcacctgatataaagatccaaccacttacttgacaactcaacttccatatgtaataggtaattcaaacgtataacatgtccaaaatagaacttttataccctacttcctgacctgctacttcctcaatcaaccacacatctattaagagtgccaatattcactcaggtgcttggaccaaatcccaagaatcaaccttgactcttctattttctttcttgcccatatctgatttgtcagcaaatccaatcatgtcttatcctttccactgtttccacctttgtataagccaacatcctctttctcctgaccaacaagtagagttatcttcctaaaacttatatcactactctacttaaaacactccagtggtcttccagtggtttttcaatgctaatggaataaaatccaaactttctaactatggtctgaaagaccccagtctagtaaatcaagaactattaatcatgcagtttggtaaatcatgacaacattaaaaaaatagagtggaataaaaatgccacagtgcaccatatgtagtaagggaaagtattttgtgatgctttttaattttaaatattaaggtataaaagataggaaaaaccaacaccactcaacacaggactactgacaccagattctccagcagacatcagttggatgtcctttcaattcggacactatctacccggtggtagcctcagatcccacaggttaacggctcagcccacaagactgcctcccaattctgatggtaatcacaagcatcaggttgtgacttgggcttctgactaatgggctataaattggagttcctacaacattcttcttaggtttgattaacttgctagcacagctcacagaattcagggaaacactttcacttatggtcattcattattataaaggatattacaaaggatacagatgaacagcctgaggtaagagatgcatagggtgacacagaattcagggaaacactttcacttatggtcatttattataaaggatattacaaaggatacagatgaacagcctgaggtaagagatgcatagggtgagacaggcaggaaggggcatggagcttccgtggcctccccaagcatgccaccatccagaaacctctgcatattcagctatccaggagctacccaatcattttggatttttatggaggcatcattacatgggcttgattgattacatcccccataagtggggagtggagatgaaagttctaactctttaattacttcttcagtttccctggaaaccagcccccatcctgaggctacccaggagcccccagccaccagtcatttcctttgcatacaaaaagacacttgtcactttggagattccaagagttttaggagctatgtgctagaaaacaagaggaatgccaaatgtatttatcttattataaatcaccatattaagttaggctatgtgtgtatttgtttgcaacacaaaacatttttcttaatatgagttacattcaaaaaatgtttgcaagcccctgacctgtatgatctggcccatgactacctctctgatcttttctaaaaccacactataccttgttcactgtgctacaacctcactaacattcactctagccctcaggcaggcaagctcacccctgcctcaggacctttgcatacattattctctctacttggaataatttatccttagacattttgtatgtatgcttctttcttaccattcatatctcaattcaagtattacctcctgctaggcatcttatctctaaagtaacaccttccgtactgttcatctcaccacagctatcttatcaccctgtttcagcttcttcttagcactgtacccatctcatctcattcatttacgtttttgtgtgtgcctttattttctacgtatttctcttagaatgtaaacctccacgagttcagggaccacatttctctggtttactactctatctttagtgcaaagaataatgtttatcacacaacaggtgctcagtaagtatttgttgaatgaataaagaaaactgaagacataattcccctctgttaaggtataatgggaaacctttggtctctcctgggcttctcagggccccgtgtagaaaagtcaaggctgtagaattagtattcaaaactcctccctttggctttgtgttcagtccaagagaccattcatttcagcacattaaactgttaattatggagtctggcttctcctttctttatgtggaaagaataaatagttattactaaatagtcatttaataggcagtggtttctttcagggcaaccattattaaaattgcacaaacatgtacataaataaagccatttacttaaaattaggacagactgacttaatggattccacttttcttactgtcctgggtactacctgcttggaatacacagtccttttttgtccttcctctcactttatttcctagctcttgccaatatgtacaccgttgatatatgactatttattcatggtaatttatttccaagactttttttttttctggggttactgatttagttaatagtatttaaaacacaaagtaattttttttggctggggagagatagccaaattgataattttatattatgtatgtcgtatgagtatggctttccctgaattttcactgcagatagacagacagaacattggtaagaaataggaacaccagactagaagtcagttatttaacgttccagtcccacctctcaccttaaccagctgaaatatttggataagtcatttaaattccctgagccttgggtttctcatttgtacaataagagggccagtttaggctttaaaaattcctgttatgtattcagacttattacattcaaagaactattataaattatcagttaatctttgcaaaaaacttacaaagtcggtactattatttctcctattttacatatgaggagaatgaggcagagagaataaataatacacattttaagtggtggagatggtttgaatctaggtagtctaaagccagaattcaaactcttattcttcttactgtaggatctctgttcctatttatctctgagagttaaatttatagctgggcatggtggctcatgtctgtaatcccagcactttgggaggccgaggtgggtggatcccttgaggtcaggagttcgagaccagcctaatatggtgaaaccccgtctctactaaaaatacaaagaaattagctaggcacagtggcatgcgcctgtagtcccagctacagtgagccgggatcacaccgctgcactccagcctgggcgacaaagcgagactctatctcaaaaatagtaataataatttaaaaaagagttaaatttataggttgtgaatccttggatctcatgttgttatagtaggtagatagtcaggcatgagtaggggaggtgaggcttcccctcatcccactaggaatgtcaggcaaccatcaggtgatggtcatgcagttgtcacgctgcctctctaaaataataattggtcgcagccagcaccaggaaaggcaggttccatatagatagaaaaagcacctgaaactggttatcatcagtctcctgatgagatctcaggatttgggcaaatgggctcaaacatgtgcattaagaggcaaaatggcagagtttcactggtatgtccatctgggggcgttccaccagtaaagggaagaatgagtcaggtgagcataagtacaactctagtaaacacactgcccatgctcacctcccaagtgctagcaggccattgtgtatgtgcgcagctcaccccaagggaagaagcaagggaaaagggatgtaagacaccagaaacatgccagcatagaaaaccctaagtccaaggtcaaatagggcacttgtcctctgagatgccctcttggccctcttccaagggtactttgctttctttgaattcatttgctttatttgaattctttcttctgaagagggaagaatcgaggttgctgaaaacccgtaaggattcacagccggtaacttgggtacccgccacagctaacatattttgttgccatgtgactccaataacttcaacctatagcaatgttagcttgtctgtatcttatttcaccagcaggctggaaactacttaagtgtaaagacgatgttcatctttgaataacctgagacaattagctccaggccttgcatgcagtaggcattcaatatttacttttaaaatgatgaggagttgggatggattcatgcaacaattttgacattaaccaggtgaaatctaaggtcctttctgagagtgtgtgattcaggcattgactgaatactcttcttgaaggagttggctgtgtctgcacagattcacctctgatttgctcctcaacttaatgcaatctggttttcagccccactgatgccactgaatctctgcttgccaaagtcaacaacacacttcgaaaggcatttcttgtcctaacctattgcatctcctgagaacatctaatattgttaactatcccctcttccttaaagcgctcatttcccttgaactggataacacagtgctgctgacttctctccatccacctctcagggtgctatgctttgtcttcattttaggatctgctttccttacctagatctacaatgttgggatctcccaagggtctgtcactggtccttctcttctcgctttccacactatactccttgggctttcccacacatatgctaaggatttttgaatctatagctccagcccagatctttctgttgagcttcagacttggtatagtggtaaaaagtgataacttactttaaaatacttccatatgaacagtatatatatgtagagtatattagtcagcatttgaaatatctaaatctggaatccacactctaggaatggataggaatttgcagtacctaatcagggatccatattcagagatggcttcaaaactgcttcatactgtgttaatagtctctcccagaaggccaaattagacagcaattttagacataatttttcgtttgtggatgagtgatacatgaactatatgtttggctataggaagggggtgtaaagacccaggaagcccagcagcctatgcctttgaagcaccactcagcgcctggcttcctgattctgtgtctctctcttcacaaagaactctgctacctgtggttgattggtcccaccacacgcaaagctcaaggctcactgtatcttgaacatctattggatagcaccttacacatcaagttcaacaggtccaaaatggaactgatcctctttgcacaaaattgatcctccttctatgttcttttatacagtaaatggatctacactcactcaatgggccaagccagaaatctggacattagtcttaacttctcccattctcatcatatccacagtcagtcaattaccaaattccatcaacatcatcacctaagtcattctcaaattcacccatttctctcccactccacaggcacctcccaaacctagggcaccagttcctctctcctgtccccagctggaccccttctactctattctttatacatcagccagagtgactcaggaaatggaaatctgtagtttaattaatatattgtagttacttataggaaaaaaaaggctgatagagaaaatatctaacaactattaaatagtataggtagcaacaagtcaaaagaaatgccaaaccacttacagtgaaaaatagttagaaaacaacacgttaaacaagccaggttattgctgcaattatcctaactttgttatgttgtagattgggcatatcactgttaacctttgtttcctctatgccaagtaatgcttgacagacagcaggctcttactgaaaaaaatgaaagaacatgaatgggaaaacattcaatcaatcaaccttttttttctccccccaacttccactcccagttttcctcttaaggaaggagtatgcctcaaaccaagaaactgagaagtttccctaaatcctattgattggtaccctggacttggaagcaactgacttcttgattttctaccagggtttagttaactccacatagtatactctatgagacgtatcattgctataaggttaatgatagttatagggcccagtcaaacatctcacagggcctatattctgtgtcacttagcagtatgatgcatcttggcccagggatttgcaaccttggcctgggaatttccaggagacaagactacctcagcacagatgcagttctcataaaccttaaaacaaagcttagcgttacaagaatagcttaaactccctttgtgaaagaaacaccttgtaactgacccagaaggaatacaggtataaggaaaggggaagaatccccaaaactctaagaatggtctctggatggaaactctcctggtcaatgggtcacctgcccctcaggctgtgccaggcccatgccaccacctgctcccgctacctgtcttttaagggttctgccagaataaactgcgtgagcatcagatgctgcctaagactcagctttgatgggaatcaaaccaatggaaagaagtttcccctagaaaagctggttacctagagtcacccaagacccccaagactgacagtccagctcaacaaatgttcattgacaatctttagcaattataatgatgaatgagtcataccctctttctcttgtaaaggtcactgtattttggtggaaataaacatgcgtttgagtcatttaagtaaataaatgttgaagctgtgttatccaacaggcagagtaaactcatatttaggatatcagcatagcaggacactgaggacatcaagaaaaatttagaagagttcgacagaattgatataaaaaaccaaagcaatcaccaatggacaagttcagagctttacgatctccttacccttatgttataatttaatatgatttttattatgtggggttacacaatagtttggtctccccaataaaagggacctcttaaatcttaatctattcctaataagtgctaaaatagatacataaatagggtgcttgggagcacgcaggaggacaattaaataggctaaggcaggggagagtagggaacaggcgaggagaaggcagcgtcaaaaggagggatgcctgagctaagtctaaaggggcaaattaaccaggtgaaggtttgggaagctaggagaggtatactgttcctctggtgggacccactcacccctctgagctagacctcccaatacttcctgctagcctagaccatcatctgttagctccctattatctattacatctgccccattgaaccttgactctgtgaaattctgagtctgtacctcccaagaggtctacctagctgcaagctccatgcttggtcgtatctcaacactcaagaatcacaacatatttattccattccaataaggctaatttgctcatggtttctatttttgtttttccttcagtgatcacctacacttctgttagtcattaaacaaatggcagctggcatcatcgccaactttcaaaaccttattcaaaagtgatcttctataggaaatctttcgagtggttagatacccacatggaaagggcttccttctcatgaaaagcaaccaatgcactttgtttagcattgtgtattcataaatatttatccattaaaaacaggcatctgtatggcaagtcccacaaggatgatttaaccaagactgcaaactcctcagctgaccacatcccatctctctttgcttcacatcatcctgctagcccctcaaatgcttggccggccaacaaccatactgtacagtcaaaaagattcatcaagtcctcacttagtttttattcaaccttattccatcacaatttctcaccaacatcagattaccggtgaaaatttgatcagagagactgaggtaagagagactcaaattatttaaatctctcaatggaagttaatagttttgaagaattagagcatttcatatgggagcaatgtcaaaataggtgacctagaactgaagtagttttccccagactctgcagttactgaattgactccccaggctgctcatattttccggctatttctgaaaagaaaaatatacaaatgcaatacccctttttttccccaaaggtctttgcttccctataaatactaaagtgtgctccttaacccacttatcctgtgagatgcctaaaaatggcctcttggatgaaataacttcaggaaacaccgtagagtatagccctggtttgaaaattcactatgaacactaacgtgttaaagaccctattacttctgtaaatagcctagttttacttcgttaactcttcctttcacaagtgtatttgggcacagatcaagtttccccttcccgcaatattatcaacaccactccatacaaaggagagttggaaacagccatgttactcctccactgaattcacacacacacggatataagtcttgtgtagtctgaggtgttcatttcaaccctggatagtaattcaaagtagcaaacagctttttgatgtttgctttgtttggttgcagaaaataagctcagggtagacagttcttcaatgacagttctttacttgcataaagctagtatggattatcccaacttttataatgacagtagttaccactgggatgcaaaagaagcaaaaagaaaaataggagttctaaggggcaggagtattagcattgcactataatgctgcagtctaagcaggcattccattactgggtcgatggtgaatacgaagtggaggttcaatcactacacacacttactcaatagtctcctctaaaaaaggcagtaaatgtcttgtttttggctcagatgaaggcctatcaaccgtcagaagtgcaggcttccacacagagattcagagcagcactacagccgctcagcatgtgaatcccaagaggcaggtgatttagtcaataggccccagagcagctattttaaacacagggcctgttctctttaaaggtacaggatttatttatttgtgggccatttaaaatttcctgctttcaccggcttttgatctggactcaggtattatatcttgtcctattttccaacatgtaacaattccttacaattataatattcacccatccatccatttggctaacattattgacaacctattatgtaccaagcactgctctgttttttttttattgcatgtaaaaatgatggtgatattataatgaatgaaataagcatttgtttttgcaatccaagtaaaatttacctgtattgaagaatgtagaggatcttgtcaggaaactaacgacactgccacatgaaggaaatcaaataaagccgggcgcggtggctcacgcctgtaatcccagcactttgggaggccaaggtgggcggatcacctgaggctgggagttcgagaccagtctgaccaacatggagaaaccccctctctactaaaaatacaaaattagccgggcatggtggcacatgcctgtaatcccagctacgagggaggctgaggcaggagaatcgcttgaacctgggaggtggaggttgtggtgagccaagatcatgccattgcactccagcctgggcaacaagagtgaaactcagtttcaaaaaaaaaaaaaaaaaaaaaatcaaataagagaaaggtgctgtgctttttgtaggtcagtgtttttcacaagacaccgatattgaaatccctggaagtacctatttaaaatgcagattctgctgggtgtggcagctcccatcggtaatcccagcactttgggaggccgaggtgggaggattgcttgagcccaggaattggagaacagcctgggcaagatagagagacccagtctctaccaaaaaaaaaaaaaaaaaaatcagccaggcatgctcacacctgcagtcccagctacacaggaggttgaagtgggaggatctgcttgagccagggaggtcaaggctgtagtggttgcaccactgcattcatacctggcaacagagcaagaccctgactcaaaaacaacaacaacaaaaaataccaaacatttggccaggtgaggtggctcatgcctgtaatcccagcactttgggaggccaaggcagtaggatggcttgaacccagaagttccagaccagtcgggcaacataagacctcatttaaaaaaaaaagagacaaagaaagaaaaaaaagtcagaatccaggaatctggatttttagcagtactctggatgttctttgtgcatccgtagtgccatatccatccctgtcatgaaggaggagaaaagaggcacacattctctccaatagaaacacctccacattcatgtcttttatttattgggtttcctgtatgacgtcttcaaaaaaaaaggatgcaagaaaaatatcacttcttttaagtgtagcacattagaaagtcacacctatgagactctttagctgcctcatcattgtattttaaatgtggcctcacagagaaaccatggattttagaatcgggaagatacacctccaccacttattagttatgtaaatttaacaagctaatttgtctgtgtgagtcttgattttctcagctataaaatggggacaatagcaaaaaataatgataagataatcagattaaaagatatatcatagagatatatatatattatcttttaatatatattaaaagatatattaaaagatatatctgtaatagagatattacagatatattatagatatagatataatagatatatgacagatatattatagacaaacacctggcaaatgagtgggcttacactgggtactccccaaaatttacccccaccccttccaaattctgccaaattttatagagtagctatataaaaattatttttatgtgttttcttaaatgctcttcttaagacattggcccttatgttgtaggaaacacctcgatgccaggttgaagttcaatacttacgttaacacattatctttctattttatatcaatgggagttatttaaaccaccatatttcttttcagcttaaattatcagaaaatttagatgtgaaattaatgctcaaaataaaaaagtgtttctcctctctatattacttatggttattcttaaaaacaaatcacccatttacttattcaacaaatcattttggccatccaataaatttattgagagggtatatcctcaagaggaagagctaagtcttatgcctgcatgtaatacactttatttattaactgagtgatgatggacaagctatttcttagcctcaaactcctcaaatgttaaattaggctaataatagtatctcgcaagattgttgcggggattacataaatcatgtacttagaacaatacctggcatttggcatgcactatagcaatgttatttagtattatttaccaaagaatagttactgaagatacacagtaaaaaagcatcttaaaaaggtaaaaagagtatataaacttacctaagtggaagttaagtgtagcataaagtatatcttataaatgaataatggagtaaatgaaattcttattcatctcatctaatgcaagaaaactcaactaccaacattatggaattttgatttgatatcactcctaactctattttcactctccctgaaggtgttcctcattttccctccttgagtctgtctatatgcaagaatggatgagcaatcagaaatgtgtgctcactgatatgtggatatagacctctgaagcatctaccccattctaagatggtccctgctcaaagggatcatgctgaagaaaggtgacccttccagctcaggtttgctctgatctccgtagcataagcaacacaaataaagaaactatagtcataggactttcgttaaatgcttagttgaagatctcaatttctgtttgcttctccttagccatattccaagttcattaccattaaaaataaaacaacatgtaatcttaatatatacaattagcaacactgtgtgctcaacgtgtctttcttaagttcttgcagacttctttcttttctcctaagaaaccccatctctttagatgagcccaactattcacactctttcctctcgctcctcaaattataatcaccgtcacatcaaagacccactaaaaggcactcactgaagcttttaaattaaggtacttgaatgacttagaaataggaatcacaaaacaaatctatttacatgcatttgtgcagaacattcctaaatgttcaggtgacactgacctactaggccctttagctcgctatgtgaggaaataagatagaatcttcaaagaagtttggttgtcaagaagcctctgggaccagtgaaacaaataattaacttatagtggaaagagaggacaagaaatgtttccctctgggcctgaaatacagtgtgctctactttgcataagttaacatcgggaggtttgaattttccaaagggcttagtggctaattagctgtgtgaagttgcccatagtgtgtccttaagactaaacattcccatttctcataaaaagctgtaatagttacatgaagcaaaagaaattatctctactatgtgtttggggtttgtctttcttgtggcctcctttttacttctattacaacacttacgacacagtactatgaagatcaactctctcttccccactacaatggaagctttcgaagtataaggattgtgtctgacttaactctgtattccatgctcctagcttgacatttagtaggctctgtattccatgctcctagcctgacatttagtaggctctgtattccatgatcctagcttgacatgtagtaggcattcaatcaataatcagtgtttttcagataagtgggctagtatgaagaccaccgagagctatccttccagggctttaaacacctctatactcagctagtagaacattcaagtaaaatacagaaacctactgaataatgagatttttttttttttgagatggagtctcaatctgttgcccaggctggaatgcactggcacgatctcggctcactgcaacctctgcctcccgtgttccagtgattctcctgcctcagcctcctgactagctgggactacaggtgtgtgccaccccagctaattttttatttttaatagagatggggtttcaccatgttggccaggctggtctcgaactcctgacctcaggtgatccacctgcctcggcctcccaaagtgctgggattacaggcatgagccactgcacccggcctacaatgagatattttctaagaataatacctgcaagtagattaattattataggcataattttaatcagaacaataaaaatttatgttttctaactagtttcgggcctaatagtttagatgcataaggaattgctcccatctgaatgtagacagagagtatgtgatgggctgagtccaagaaaatgaaaccataaaaccaaagtcctacatttaaaattttaaaaagcagcaagacagaatggaagacagcgactgaaacacatgagttttcctgctgaccacaagcaccctagcagtcagaagtgggatgaaagctaataacacaatactcagctgcattaattcagtgggtcagtatttttatcagagagagtaaactttactttgcttttgggttctatccataaattgtgtgtgtgtgtgtatatatatatatatatataaaatattgtgtatatataatattacgtgtataatcatgttttaaagacctatatttagttgcactaaataatcaaagctaaggaaatctggatcttgtgaatttcctctagcttcttctccttattctgctctatgatagctcacaaccatagctaaaacatcctgagcatcttctatcagcagtcaggtactacagtaatacattacctatattcactcatttaagatttacaacaactattattactctctttactgcagatgaggaaacagaagcaccataaaactggggaaccagtccaaggtcaaaaagtttatgagtggaggagctgagcttgatcaagggagtgtggcatctgagtctgaatcctgatccctgtctcacatcatcttttctcgagacagacttggaaatggaagacagagggaagcagtgtagtttattttagtcttggtgagtgggagaaagatgtttaaaatatggatgcagcttagacgttgatatagtttggatgttgtccctgcccaaatctcatgatgaaatgtgctctccagtgttggaggcggggcctgttgggaggtgaccggatcatgagggtggatttctcgtgagtggcttagtatcatccccttggtactgttgttgcaataggaagggagttctcatgagatttggttgtttgtttaaaagtgtgtagcacctccccctcctcttgctcctgcttttcacctgtgtgtgtctgttccccttttgccttctgccatgactggaagctccctgaagactccccagaagcagatgcctccatgcttcctctacagcctgcagaaccgtgagccaattaaatctcttttctttacaaattactcagtctcaggtatttctttacagcaagaatgtcctatagagatgtggatacttttttcccccaatcttggccactatcatgtcctttaagttatcagagatatataggtgtgttttcaaaccagtagtgtatttttgtataaataagaaattagcaattgattctcacttattccatttctccagagatacaatgctgacacatcccgaatttaaaagcattttaccacctagtggtgggtaccttgagaaactgccagatactccaatagctcagagcaataaagaagaacgggggaaaatttgctaacataaattttaagtggaaccatttacatcttggtaaatcttccctatatgtcaataaaagaaaaataaaagcattatattaataataatcataatgagaagaaattatacagtgatatcaatttccttggggagggtggatagtagtataacacgcttctcatttatttaatttttcatatgtggctttttgtactactgaaatggtaaaccatccatgagggtgtggctgaaagggatgtttagtttatgtacaaaaatgcaggagaagcacacccctagtccttcactgacatatttccgaaacatcagaaaatattctaatcaaaaccgctgttgattggaacaggataatagaaaattcaattgaaacaaaagtaaatgaaagaagaaaaacaatcggagtctctattaaagaagaatttatatgtcatgaattccttctattttactgggtaccttatttgatcatttaatacttgcaacaatgttgtgagaaaggtattggtatcctcattttactgatgagaaaattgggtttcagatactgtaggtgctcaatgtcacacacaagttaggcaggtttcaaagaggttcagatgacaaagcctctgcctaggatgacacctcatctaagaaggacagcagtcacctgctcacagggaggtgatccacacttgtgctctgatgccaagtgtcaggtggacagaggtgaagagacataacatctggaaacatgagtagaagaaagctcaccaggagcagcagagctggttattttcgtgaaagataaattgatgggttgcttgctgatagcttgcagtgctattccagataggctggtaacccaaataacttgtggaattctccacagctgaggagaaatggaaaaaaaaaaaaaaaagcactagccaagaagtcattcgattatgctaaacaaaatcaattcatttatgacttttcactttcgtaaggtggggaatgagtggtttcttaacgttcatccagcaattgttttctagcctcattgcacgactgctttttaagttcaccttgacctaaaggcaaccttacaaaatgctttgcaaagttgtggaaatgttgcattccacatggttgtgaatagaaagagcttcttgaggccttgattagagctgggtggagctaagcctgaaacagatgatggctacactacactgcaggcccagctgccctgcccatgggcacaacagcaaacccagagacagtgcagggaggctgggaatgggtcaagtttaaattaggcacaggatttggcaagccactacataaaaatacaacagcccaacagaaggccacgtttgggtagccagccgtcgtcaagtgcaatgtgggaggcgccctgtctggaagagaaaatgggaaagaatccaccataagaacatgactcaaagaggtcagtgatgggcataaaaatatgtccattgcttctcagaaatcttgccaagaggactggatttctaataccagcaagcaccaagaaacagaataagaagaactagattgtcctcctttttctgatgtttactaaacctctattttctaactatattggtggcaggtagcattttctataaaaacctagctttctctggtacttttactttttttctgcctctatagaaatttcaccttagtttatagctggaggaacatactcttcatttaattttcctatctgccttgctgggcaggtggttttggactgaactgattacattttaggtaacaggatatttctcagagacagcatgtcttgctgggtattttgggattcatggaaaataaaaagaaaaaatgaaaagaaatccattcacctttcatggcagtgatttagtagacattctgtggtctctattaggaactgacccgaatagaaagctagattagcctaaaaaaataaaaaaatgtagaatctggtttacaaaactccttagtttctgtttttatgccttagagaacatgtatgagttcaaatataattacaaataagtaaaaatatgtcaggcctatgtttaagtgttttttttttttttgtatttactagcagtgatgtttttgtcaaaacatttttattctctgatctttagtcactttactgtaaaatgaagatgaagtcagctctgcttatctcacaagtcttttgaaagactccaataaaacactgtgtagaatcttcgttaagccttaggtgttcagttaattttaaggtataattttactatctctacaaaaaaatttaaaaaaaattagctgggcatggtggtatgtgcctgtagacccagctacttgggaggctgagatgggaggatcccttgggcccaggagttcaaggctgtagtgagctatgatcacactattgcactccagcctgacagatgacagagtgagaccctgtcaaaaaaaaaaaaaaaaaaaaacaagaaagaaagaagaggaaagaatatactatgtgatagttgttaattagaattttattttgtcttattgaaaaatttcttctcactttgaaatttactagagtaagttggaattattagtttttcagaaacagagagagctggaaagccatctttatgacatccctcattacagaccaaccaccaagtgatctaactggtacatataccttgaaagacatctgataaacacagagcacacctgatgagttaagccaggtggaggtaaaagctacatttttcattaaaataccacagtgctggaaatttctaaaagaccttgagtggtgatagttgtaggggatgccctggccaaagtggcctgtggcgttgcatgctcccacaaaagccatgtaggcaagactcaatggcgttggaaccgtgtctgggcagaatgctctgttttcctttctggaacatggcatgatgagcaagctatccacggctgtcgcaggccatttcacatccacctccctatcttgcaggaggctctgtgtcctgccgaaggttgtcatgaggctctttcccatcaacctacctggtaccagtgaggcatggaattttccccctcgcccttcttggatacagctgcggaccgtaaaaccattcagctctagtatgaaattgacttctcaactacagagtggctcactccctgtgatgcgtgttttccggtccctccaggttgatggtgtcctgtggggacagggatgagaccctgaagaagtatatgctgggttactgaagctgaatcaatgcttttctccaggtgtgtgtatttatgcacctgtcttttctcgaggggactccctaagctcccagccaggtaatatgcacacgatagcaccagaggcaggatggagaaaggaggtcaagctctccaagttcagtaatataggcatgtatttacatgccttttctatcccaggtcttgccactgtctggtgttctcaagtcaggagcttctcagtattttcaaataataaacctctgtggcctccctgggaggctgcatggagtaggggaagaccctggagatctagcttcctctagatccattcttacaataaatccatctctttccagccctgttcctcaatctcatttctcatggtgctgagttccatggggcaaactggttcattaatcacaggtatctccatgttgagagctgggttgtagctctatcctttctgctaaggcaattactgctcttccatcacttcccttcctttattccaaaaaaaaccccacatctttcattcattatttccttctgtcctgttctccttgtccttgtggattaccacctttcgaacatttctttattgcagcttctattggtttggggaagaacgggagactaactctactggccagttttccatctgtaatgataaattcccagcacaggtgggtggaatatgcatccttcttgtattcttagtgcatttcacagaacctgactacagaaggtgctcaaaaaaaaatcagtattgaagaggtggctacatacaacaaatgtacactttggctacaaagttagataaactagcttgttcagcaaacattttcagagtatagtattctatactaggacccttgacactggatgccagggcagataaaacacaattcttattctttattgtcagtaatgtggtgaaagtcccttggaatcgggtgaatctgcaaaatttcagtgggaacaagagcatgcaccacccaggcttatgtcctagtctttccagggtctgggagtaagaaaaagatacagaaacctgattacagtcatacagttaataagttaacagacaacaccctgtggaattaattcacctttcaatattcattataaatgccgtcttccttctttgaatctctgcaattgtggcaagccaagtttatgccgtaccttagcgataaaagtagagatgattaactgtctttctgtctttgtctcttcgttcctttttttttttttttgatagagtcttgctttgttgcccaggctggagtgcagtggcacgatctcagctcaccgtaacctccgcctcccaggttcaagtgattctcgtgcctcagactctcgagtagctgagattacaggcatgtgccaccaggcctggctaatttttgtatttttagtagagatggggttttgccatgttggccaggctggcaaactcctgacctgaagtgacccacccatctcagcccctcaaagtgctgggattacaggcttgagccatcatgccctcctgtctcttagtttgttttaattttaagaggaacaatggtgctttgttttggtttatgccacccaaagaaatagaagtatgcaactttaaaagaaaattttcagccaagggtaaaaacataaaaataaaaataaccaaattggtgtcagatgcaaagaatcccttgaaaattggtgaggattgaggaatagagaaggatactgaagagggatctattattcaaaactcaattaccagaaacccaagttaaactaaaggaagtgggaatttaatgtctcagtagctgcaaagcttcaggtacagctggagccaggtattcaaacgcaattgttaggttcttccctcttctgtactggcttcacgttcagacagatttcattctcgtgtttacacctaacagcttagcaatcagtgcagaaatattctctttccccaacagttctagcgaaagtactggccacaagtctctgacttgccaaacctgagtcacattcctcctcctcaccctcactccagaggactgggttgccctgctcaaaccatatgaaccgagagtcaggtcaggttgttacacaaaggaaatccaaggaaatgttgccaggaaaaggggagaaggcttttaagccagtatatgcggtagctacaattagtgtaagataatactggccctggagttttggctgcatcaccacttaaaaaaaaatttaagttttgaattaagccaaattgcttagcacagaaggctggtttggagtgtagctatttttgaattatttactgagcttcccactgcatttgccccccacaactcttagcatccatctcttgctaaaaggccacctgaccagaatgttaagagaaatatccaatagcctctacagaaagagtagaatatttatttttagctttatgatatttgttcttaaatgcttttcagcctggaatgacttcaatgagatttgtacatttaaaggctgccaaaaaaagaagggggaaaagtcgaatattaaagaaaatctcactcacatccaaaagtggaagattctttaaacttttaaagaaaatgttagttctatttttaactcacttttgggttgtctaaggcttaagactaacataagaagaaataggtcgagcaacaaaaacttgaaaaccaaaagattttatacttgggaattaaccttttattaaccctaaccctaacccccttttgacgaggagaaaaagagagagaaaggagacccttctatgtgcaattcagggttcagtcatctcagaattttccatatacaggccctagatcaggggtgtccagtattttggcttccctgagccacattggaagaagaagaattgtcttgggccatacataaatcacactaacactaacgatacctgataagaaaaaaaaatgcaaaaacgtctcatcatgttttaagaaagtttacaaatgtgtgttgggccacattcaaagtcattctgggccacatgcagcctgtgggccatgggttggacaagcttgccctagatgatttttctaaaaggaaatttgttctgaaagacagtagtcagtatacctttacacaatttcatgaagatgtctgggttatgagaattgtcctactaggaagagctaccaaaatagctcatcaccttgaggtactgtggagtgaaagtgaccaggtgctttacatcaagtttacaccaagctttactttccaaactttttaaactgtcagtacaactccttttgaacatatcttctaggttggctcttggagtgatacatccatcaccccattctactccaaattcatttgaaattggcaattttcaggttccaacttgcgatggcttaacactccaggcctccctaagatggcactgaacatagggcagccctcctggaggaccccacagagaggccatggagcatgagagtgagctgtacctggcatgatgtatgcaacgtggcttattctctttgattcaggttttacgtttctcgaatggagcctcttctaggttgctatccatttacctccccatctctctctctctttgccttttcctggttgagtccttcccgggttaacccagccctcctgatggcttcccttcactttgaaatccacagacaggaacaactctacatttaatgataaactgtcttacattcctccctaattagttcaaattgaaagtttgctctcacatttggaattttagtatggctatgataaatacttgtgggctcctcactcggagcaatctctgaacagacgatctgaagctagatatacaacattctcatatagtgttcagtgtgaatcaatatcaaagtttaaattcccagtgatattaatgaaagaggtgagaatttgttgctcatatcaataagaattagacctaaaatcacactagtgatctttggacttaatttagtgttcattcatttagatacaaactgagtgtatagtttctgtttaaaggaagagtattttgtccgtgatcaccggtgcacccaatggccaattgatttctgtttacattctgataattctttgcttatcagatcatttcacatgagaatcaagccctctgcaataagcagtgggaaaaattttagtcggtgagaaactccaacgcctcaaaagaaagagtgtaactttcaaaactgtcatttttgttctcatggtaaaaatctgactttgtgtcaatcattccccaaatcttcagttgaggaaagaggtcatgctctacattaattacagatgacaagctagagacaaaactaaaagtccaaccttataacttcgcttttctgcctctccctggtcaaaacaaaccctcttataccaactattcttttttatcacttgagtgctatgtacagggtaaaagtaggattacctcagaataataatttcacacataatttttgtaagaaaagggttcatgataatacttttaaaaataaacagctagcccaaatattcctccataacaaaatgtgacaaaaggaagttagaacaaaatcttaatttacacagaaagtaaaactgtttccctgtaaacaagctgggctgtcatgaaaatggataagggttcacagaaatttgacccaaagaataaagaatgaacggatgacacaaaaatggctaactggataaaaatatgttctgtgtgattaataataagtctccaaatcacagtacttggagagaagggatgggcatactactgtggaattctggatgtgtcaagatctggcctgggttctgggaacactggatctctttgttcctctctctgctgttcagggacagtggaaggggaggaaaaagggatcgtggtccagtgtacgtggctcagggactgggcctctggaagccacagggaccagcgatagtcacacttcttcagccctccagcgattgctctctgtttctgttctgttttcacactgttatccttcagcacagctctgtgcgctgtttgcctctcctccactggtggctgctctctgctaaataagcatgccacttgttcactgggtaaagtgaaaaagacgttgcttgtaaaataattgagtctccaaaaaaagaaaaagaaagcgtctggatcactatccgtgtcacccctaccctgagaagtctcttaccggggtgacttttcttcaaagaaagcattttccaaactaagtgcagaatgaagcaaaaaacaggaaagaactcagattattttatgacgtcacatgatgctgaattacagggtggaaagaaacagaaacacagaccactgacttattggagagagagagatatatataccatgtatacgtaatattatatgtcatataaaatatatttaattacatataatatatatttatagatctccatggcctgtgcttctatggaatcaaattgttgtgtatgcatctatgggcatatacagaaatattatatattaatatataaataatatatatgttgtttagatggagagagatcagaggagcactgaccatggaaatatagataatatacaatatatataaaaacatataacatatttttcctgtgatatgtgcttctggtctctgtgtgtgtgtgtgtgtgtgtgtgtgtgtgtgtgtgtgtgtgtggcataaactgatactacaaaagcacagatcaccaaaatagtatatataaaatatatatacagcatattatgtattatataatatgtggtctgtggtcctagatatctatacacacataatgcacacacacacgtaagttatgtgtgtgtgtgtgtgtatatacacatacatatacatatcctaatctggtagcacttttgttgttgttgtttagattcagggggtacatgtgcaggtgatctgtattatttattcttccttgttccatatatattagattaaccaagatttaaatatcagctctattactaacagtaacacctggaccaagttatttaacttctgtttacttataagaccataaatatataaattaatacatttaaggaatacttactgaatgctggtagagtatgagcacttaataaatgctagtagttgctgacagcacttatgaccaaaacactttcacaatcatatatgcatcagagccagggctgccgtttaaaatataatgttctcatttgcaacgggagaaatggcacgaaaatccaggcccctctaccaccggtatgtactctttccactactcagacagaggaatacttacatttgaatgagaatatccaatcttctaaaaattaactgtaaaccaaacgacaaaatttaaatggagagtgtttggggggctctggaggaatttgaaacttgtatttaatttcctggctcttcatcctgaaatgcgtctaagctagtaacagacagcaaaaccgagttcctatctctctagtgttccctgctgagataaaagcgatgtgcagcaccggatgccaacagagcaaataattacactgagtgctctttccacagccaatgaatcggaaagtgaaatttttgtggatgcacctgagtgctggggacatcagctgtcctatgagaagtcattaacattttctgaatgtctactgtgtgccaaacactgattactaaagaggacgcaaattgaaatgagagattattcttgtactccaggtgcttaaagccgttattaaggatcatatcacatgtccatcgagaataaaatgtcaggtaagaaaaattccatgaagaagaacagagtgctaggaaaatgcaagaaaaggaatgattaatgccagctagcttggggagggggctatgatgagagaaaggctaaggacagggacagtgagacagggacagttctctctcctagaattattaggaggtaaaaatttggagctcttctacttatgattaaacagaaagaggcatgaggagaaaaccaaatgatgtcatcagaataaaaaggcactgcaaaacagtagattatacatgcaccttgaatgtgctgtctgataaatcagcattttacaaaaacacatccggactagcaattcagaagaaagcaatgttaatgcattaattcaaagagagcaagccatccccaccctcaccccataggcttttatttatttatttatttatttattttagcagcctataatctctaggatttaaaaaaataactcaccaatgaacagaattaaacttctcaggtctgttgctttaaagaatagccaatatttgtgagaaacaatttcaagagaagattactacaaaatgaaaatgtaatatgtctgcatcagttaaatctcccaaaacaaatttgcaatattgcctctgactttgacgattttattctttcagtaacagtccagatggcatccaatgagtattgacatcatcatcataaaaaaaggctaagaaagtcaaaatgggatttatttaggacaaaaattaatatcaatagataatgatcttaaatttaaaggatgaggcatgaaaaaaacaattaataaaccttttatcttcctggaagatttccatttgatatgtatagtcatttgttgtgaggaatagaaaaaaaaaaagacacattaaagagtgtaaaaggctataaggtaccttgagaatgtagaaaataattattatttaatgaaagtgatagctaagaattcaaaaaataccctttggctatctgataagaaaacctatgccgatactatagcaaatctaacataagtaattttttggccttgcaatagattaactacctaggacgtaagaaaatgtctaaatctgggcttaatccaagcctctggaggtggtaataaagtcattaataataatggtaaaaactataataatcttttcagtttttgctcaccttctatgtgttccatacaccagttagaaatactgaattgtccagtgacatcaccataaaaaataaggataaagtccaaatataccatttttttcttgttcatctgttgtgtatgcgttatccagagtcactcttttagaaccatatatatttttaacacatgactggtaacaagttctaccttttaattacataggctaagtaaattactaacatctcttttatgtctgaaagcttccttttcaaggaatgccttcttatggaacctctcaagctctgtgaagtctgcctgaagactggatttaaaaatagcataaaatggtcctaatttaatttatggcctgaggagcccatattcacgtggtttcgaatatgggtaggattgttttctttttctgtccaatatcctcccacctcactcaagaccttacgtggtcttattgatcacgggagcacactggagcggtgactttatgaactaggctatccgtgacccttgggtccctttaatgggccttaactgttagtgctgaacctgccctcccaaaagtcacctttgcattatttttcataaatgtattattttctatgtgggtcaactggatctctcttgataactttctgttcttcacatatctcaatgttctcatctttttttctttcttggcttagatgcccactttttagtacagtctgacataatctgcaagtttgaaaattccagatgcctataaagataacatttaaatgctagctaagataaaactcaacaccagctgggatcccccaaacttccagaaagttgtttgtttatgcctgcactatgtttgctgccttttatgccactccttaacctgccaaaacagtcccaaacactgccatggagaggcctatttggggtagaaatgtattagaggtttggggaaacactaaataaagtacatcgatttcccctttcctcaaagtcaagaaacaaagttacaatcttagtgaagttcaatatttcttcatagactcttggccttgtgcctgcacaatgaatggatcacgtcaggttcccatgtagggatgagagaacaggaagttcattcctatgattcttggagtctttttcagagagtacttaaggataggcaaacagtattctgtaggcacagtgatatatgttgcagaaaaatgtgcattttggtccatcattaatgatttactgttgagtacagtttacaatcttaagtaaaataattcatctccagagatttatttactgcttttggccacacagcaataaaatgatttggttgtactgagaagaatttccctttaccaaggccatcacagggagaaggtatggtgttccaggtaaaggatagcataatagaaccatttcagtcaatcaacacagttggtagtcagagagaaggcttctttgtagatgttgatagacatatttatgtatttggaaagaattttccctttatggaatagagttattcagaagacaaagggtccagctaagtttgggaataagtcgatacacctgagttacttgcacagaaatatctcaaaggaattattgtaattatgtaattattgtaattcccttgagatattgtaagtcaatggaagctgtgaaggttttattttcccaatccaaaatcacctccagtcccaataatattcactccaaatataaaatggcaaattcacatgttcagaaggcactacacagaagcagcaccacaagcgacagctatctaggaaaagaaaacagtccctgagactagaatatatggctacaaagaaaaccaaagctaaaatcaaagcatttagatattgccaattttgtactgttccttcgaacattctggtgaaaataagtcagagcttgtctttcatcttggtcgtatcagatggatccaaccacatttaaaaacaaatcatttctctaattactgtgatggttactagaggctgggaagggtgaggggtgataaagcgaagttggttaacaggtacaaaaatacagtctgatagaaggagtaagttctagtattcaatagtacattatcgaaattacagttaacaataattgttgtgtatttcaaaatagttagaagagaagaattgtaatgttcctgacacaaagaaaagataaatatttaaagtgatggatatcccaattaccctgacttgatcattacccactttatatatgtatcaatatatcacatgtactgccaaaatatgtacaactatgatataagataagataaattatttctctacaaatacaatgagaactttgtcattgcccagcaggatttagctattagaaaaagaattatattaggctgggtgcagtggctcatgcctgtaatcccagcactttgggaggccaaggcacacgggtcacttgaggtcaggagttcaagaccagcctggccaacatggtgaaaccctgtctctactaaaaatacaaaaattagtcaggtgtggtggtacctgcttgtaatcccagctatttgggaggctgaggcagaaggcttgcttgaatctgggaggcaagaggttgtagtgagccaagatcatgacactgcactccagcctgggcgacagagcgagactctgtctcaaaaaaaaaaaaaaaagaaaaagaaaaagaaacaaaacaaaacaaaacaaaacaaaacaagacaaaaaaaaagaaaagaaaagaaagttttatgtcagagcccaagtggttgagattaacattctttactatttctaaccacttcaaggtgctaatttacaataaggaaagagtaacaaccattaggggaatatagactctttcatagcaaggttaattgaagtgtccatttgactatgtgacatctcactttcccctcttgttccgcagctcgattggctatgtagttattatgtgcaagttgcatagttactcagttctgtcagagaggatgtgtgaagaagatgaaaaagaaaggactagctttttgcaaattggtcatgtctcttgcggatctagttaacatttcctgttttctgcaagaattaatttttttcctaatgaactttaagaactaccaatatttttagtatactctttctttcttatttatttgtacattatctgtttgtatccttgaattttctctgggatgttataaaagaaaaatattacaagcataatttctgacacaatgttttataactgttttcaaaagcaatctatttctctcttaatttctatagaacccattttagtcattcctatgatgaatgaaaaaaaactcacaattagttgtcagtttcagaaaggagtctcagaagcatcttagaaccacctaggcggtcttataggcgtcacagaaaaatattccaccttacttattcttatcttcttcaaactgactccaaatataataagcaggcttaagttatataaggttccttaaaagttgttctcaaaaacaattaaatgcagactgtcctcagtaaaacttgcattggcccagtccattttaccaagtttgctccttcttacatgtacgactgcccctgtgacaagtttaagcctacgttaattaatcatctttccataacactgagacatattcatccaaccctgagagggataaggggtaacaggcaagatatattcaaattgtgacatttaaggtcaacttgactttaaaactcatatactgctcagttttcatatacgtggctgaaaacaagtcatcacagagaactggtcacactgttagaggaccaaaatagtaaaatatgaacaattcttccatatttaatgatattaaatataacaggtcctatgtctatgcaattgaagtcaacatgtcactaattagggcttcctttgttatcaaacttgctgagaagatagaacagtgaggaaaaaatagcaggaattgagctgtacagaattaaagacattcttatgaaccttaagacttaaggtcagtcacactcatatgacatttggactattagacaactcttctgacctcaaattttgctcttaccagttggtgataatcctttggtaagagagcatgttaaaagtaaccaaatcagataaggactagaagtcaaatttcaacagaagagggcaatgagactccgtgccttaattatcaacatttttatgatgaagaaccttcctaaactaatgaaaaatacaagacagaaacagatgaaacacagaaatggctgaaaagaactccctattaatttctgaccattttcttccctattaacagtgcttgatgatctggagtgaatacctgcctttttggctcctgccaattagttcaggaagttccatcttcaaacacattcagtgacctgatttaataggggcctttttatttgatcgccgccaacaggcagtcctacagacttttataatcacagtgggctgctttacaggcaagtcaaattccagtttaatgaaaacctacatcattacaaggaattgagaagggaattctggtttcttttctgctatggcttacactggaagcatagtaactttccaatgaatccatgcaggagaatggaattcatccaatagggaaagcctcatttttctctatggtagaatggtagaattaatgaatatcaagaacacgagaacattttgtaacatcctgctggttaagtatgtttcattcctagctaggttaatatggataggctgggggcagtggtggtggatatttccagagatattacctgaagtttaacaaaacattggttttaagcttgtacatcatgaactcggggacagcttctctctcacactctatttatttatttatttttgagacagagtctctctgtcatccagactggactgcagtggcgtgatcttggctcactgcaacctccgcctcccagggtcaagcaattctcctgactcagcctcccgggtagctgggattataggcccgcaccatcatgcccggctaattttttatattttttttagtagatatggggttttgccatgttggccaggctaggctggtctcgaactcctgacctcaggtgatctgcccacctcggcctcccaaagtgctgggattacaggcgtgagccaccacacctggcctccctcatactttcttatgcaccaatcatgacccattttgaaagaggcagagtggtggaaggtttggacttcatgtgctgactggttctctttgttaagactcaaataaaaccactggagtcctatccactgaatgctagatctcaagacatagcacaatgggattcctggttacttacaagcggtctttatggttccccagaacatcttcccttgagcctgcttcccttgctgctccaagtgaactaaggccagaaactaacagcaagcacacaggaactgtgggctctgtgctcccctcggtgtttctgttccatagaggcccatcatctttagcgacttgattttctcattccacacacaactccaacaggtatctcatgtattcattggtttcaaatatgtgtgtgaataaatccctctaaatttcagacctgtatatccaacagtttccagggcatctcatctggttgttctacatacgttgcctgaaagtgaatatagccaaaacatatcatgccttcgtcattctctccatgaagaaagaaaggaagagagaatctcttgtgtttcccaatgtgaaaggcatagtggtgcattcattgtcaaagtcatacatatgggtgacatcactgttggtagggccttctcccttaactcacctgcccccctcacttcccgcaccaccacccctaatcctcccattgagttagtaatgaagtccttcctatgtcctgaaagtctcccgtgcatcctattttttcttaaatctcactggcctgccttgggtcaagccttcatcatctctgctctagactacagccacagtacccagccttgtctcccttttctaccatctgatgtttattctctacatttccccccacccagaggaatatgtttggaaaaaaaaaaagaaaaacaaatactgctatttccctgctcaaaattttcaatggctctttactcttttcaggatgaaatttgaactcctccagattctaactgttgtcttctgccttcctctctggagtcatccctctgcactttccaaacacctcatcctgtgcaaaggtcacgcgacaatatttggagttcccagagctcgccagaccctttcacaccttcgagctgttgcacaggcgctcctcttttccctggctaagtctgactcaggctttacaatgaagctctgacatcaccatctccaagaaaagcctctgaccccaggaacctgagtgaaattccacacactcctgcagccctctgggtttacctctattgtggaaattatctcactttcttgatttgtccttctcctccctagactgtgatcccctcgaggacagacagcatggcttaattctctgtatcgctaggcctgacaaaacgctcacacacagtaggctcctgaacgatgtttaatttattgttaacacataggattccacagatcctgaggtacagcagacttcagatacccacttcaaagaaaacaagggagtaatgcctaggttcttgttcctatgatttatactgtgaataaaataatttcagagaagttcctttattcacttgaacaatatttaaagggcaaaaaaaattaacaaaaggtctttttaaaaatgcaaataatttacatttgttgataaagccatacaatcacaaaagtgaccatatgaatgcaaatattccttctaaaaagtataattattattcacccatctaacaaatattaatgaacccctctgatgttagatgctctttatggtacaggggttagcagagtgggtacatggaagcttcctgtagtttacactatcatctggaaggcgattaatcaaatactacttactgttcatgagtttataattataaaatggagggaaatactctgaaagagaagagtgtggttttataaaaccatataagaggctgggtgcggtggctcaggcctgtaaccccagcactttgggaggccgaggtgggcagatcacttgaggtcagcagtttgagatcagcccaggcaacatggcaaaagcccgtctctactaaaactacaaaaattagctgggcgtggcagtgcatgcctgtaatcccagctactcgggaggctgaggcaggagaatcgcttgaacccagaaggcagaagttgcagtgagctgagatcatgcaactgcactccagcctgagccacagagcaagactccatctctctctctctctctctctctctctctctctatatatatatatatatatacacacacacacatatatatatacacacacacatatatatatacacacatatatatatatacacacacacacatatatatatatacatatatatatagaaactggcttagacctaaggtgagtgggtctcaactgggcataggggaaaaggagggaaagcattttagatggaggaaaaaacagggcagggataaatcttcaagaccagagtggccatggaaaagtcacctctataactagaatcaagagagtgagagaggaagtgataccagatgaggtctgagaggcagggagggactgatccaggatgctgcttaagggtgaagaggatcagaacacgccaccaaaaaacataccattttggcatactgattattctgaggtaaaggcaattgagaaacagaaaatgcatgaagggctctccacctttcccttttctgcctaaaagcaggacataggtaaacgtacccttgccaaaccccaaaaaccagagactaaaatgaaacacagtcagagcccagaaatcatattttaaccatgaacaccccaacaattaccccctgattgacgtaattttcctaaaaatcttaagcccctccaactaaattaatcctccattttgtataacaaatataaaaactaaacttccaccgtaatactaataccttcagcatatccctctgaaaatgtgtatgtttctcctgttaatctgtcttttgttatcttaattagtaagaaccataaacagaccataagagagaacaggagcactttgggaggaagaggtgggcagatcacgaggtcaggagatcgagaccatcctggctaacacagtgaaaccccgtctctactaaaaatacaaaaaattagccgggcgtggtggcaggtgcctgtagtcccagctactcgggaggctgaggcaggagaatcgcttgaacctggcaggcggaagttgcagtgagttgagatggcgcgagttgagactgcgcgactgcactccagcctgggccacagagcaagactccatctctctctctctctctctctctctctctctctctctctctctatatatatatatatatatatatatatatatatactggcttagacctaaggtgagtgggtctcaactgggcataggggaaaaggagggaaagcattttagatggaggaaaaagcagagcagggataagtctccatgaccagagttgccatggaaaagtgacctctatagctagaatcaagagagcaagagaggaagtgataccagatgaggtctgagaggcagggagggactgatccaggatgctgcttaagggtgaagaggatcagcacaccaccaaaaaacataccattttggcatattgattattctgaggtaaaggcaattgagaaacagaaagtgcatgaagggctctccacctttcccttttctgcctaaaagcaggacataggtaaacgtacccttgccaaaccccaaaaaccagagactaaaatgaaatacagtcagagcccagaaatcatattttaaccatgaacaccccaacagttacccctcgattgatgtaattttcctaaaaatctaagaccctccaactaatcctccatttttgtataacaaatataataactaaacttccaccctaatactaataccttcagcatatccctctgaaaatgtgtatgtttctcctgttaatctgtcttttgttatcgtaattagtaagaaccataaacagaccataagagagaacaggagcactttgggaggaagaggtgggcagatcacgaggtcaggagatcgagaccatcccggctaacacggtgaaaccccgtctctactaaaaatacaaaaaaattagccgggcgcctgtagtcccagctactcgggaggctgaggcaggagaatggcgtgaacctgggaggtggagcttgaagtgagccgagatcgcgccactgcactccagcctgggcggcagagtgagactccatctcaaaaaaaaaaaaaaaaaaagagagagagaacaggaaaactttttttcttccatagggatcttgtttggaatttcggtcttaatcctaaaatcaaagatggattttaattggacaggtttgcaatttgaaaatagtagtgtggctgccctttggagaaaggcaggatgaggtgcaggtgcatgtggagactagttaggaatcaatgagatagttcaggtaagcggagataagattttgcagtagagaaatacaagcatacatggtccaagctaagctgacagcacttgtggatgcaacagatatgagaagagggggataagaagagtcaaggcgaccccggcatttctggcatgtgcaatttttactgaggcagaaaccagggaaggggctgagggtaagacaatgactctcatcttggacatgtgcagtttgagacttctttgacatacccaagcgaaaatactgtatacacagttgaatttactggagttcagagaaaaggtctgaattagaaacatacatttagaaatatttaatttaagccatgagacggatggcattgccttgagaaaaaaaaagtagagtgagatttccattgatgtgttgctatttcaattaccttgtaaatagtctagtttattattatcttatcctattaattgttcttccactctttctccttcactgggttctctgaattatagaatttatgcagaaaacaaacttggagatcatcagatataatctccaaattttacaggtgaaaaaactatagtgggttactcaggatcacactgctccttagaggtaaaaatgaagacaaaagctcaggtgtttttgatgagtactccacaggactacatctggaacaggagcatgttgggagatgaatgtaagagtcccaggtacccagaatcctaccaattctgacatgcgtgtgcttgtcataatgaaacaacacaggacatcatgtgaaggacaactaacgtggggttacccatgaggtggtgagaaacagaatgggattttgcctcaaacccactgtggtttacacattagtaaactgttcaaaatggggccaaaagcttgaactctctgaccctctatttccttctctaggaaatggagaaaagcaatcattaccttgaagtgttgaaaggaataaaacgaatgtatttaaagccactaaccacatagaaggtttccaaattactaactaatattttcctccaaagtaaagaaaaaaaacagatgtcatcaaaataataaagctggccgggcactgtggctcacgcctgtaatcttaacactttgggaggccgaggcaggtggatcacgaggtagggagatcgagaccatcttggctaacacggtgaaaccccgtctctattaaaaatacaaaaaattagccaaatgtggtggcaggcacctgtagtcccagctactcgggaggctgaggcaggagaatggcgtgaacccaggaggcggagcttgcagtgagctgagatcacgccactgcactccagcctgggcgacagagcgagactctgtctcaataaataaataaataaataaataaataaataaataaataaataaataaaaaagctggccggatgcaatggctcgcatctgtaatcttaacactttgggaggaagagacatgaggatctcttgagtccaggagtttgagactagcctgggtaatgcagtgagaccctatcactacaaaaagtttaaaaaattagccagatgtgttggtgcatgcctgtagtcccagctacttgggaggctaaggcaggaagattgcttgagcccaggaatttgaggctggagtgagccatgactgtgccactgtgctccagcctgaatgacagaatgagactctgcctcaaacaaacaaaccaaaaaaccaactttattatttaaaaaaatctcaagggctcattgaaattatttggaaacattaaaatattttttaaaatattaaaaaagcaattattccggtcatcagggtttaaagcctatttattatataatgcacctaaaatttataaagcacccatgattatgaatcaaaacatctatatccaaatagtatttgatattattatactgtaatgtattttctagaatacagcacacaagaaaccacgtgctatttcaatatcttgttaagcaagtgaaaacctatgttgtcagttttaattcactcaaatatgcctgtagccaaggtaaatggtatagtttaaaatagtaccacaaatgaagcaactatcttacaaatttaaaattaatcatttcctcttttattcataaacttttatgcttcatctggatttggatctctattcttctaaaatttagagttttaagtacaaaggattttttagctggtatgagtgttatagtttgctttaccaaagattttcagatgagagaatgaataaacattgtaagttacaggatatgaattccagggaaagagctatcatgcaagaataagacttatggatttcatttacagaaaatcttcagcaaaatctacaaatatatttttagctatatagttattttttcaatttgaagacataatggtgttaacagtgactgagcacttttatgaaactctcatggaataatatttgaacttcatctttttctattgtggtagagcacttgttcaaagccaagatgtatatccccacttgtatggggcagattccgggcaaaaccactccttaccacaaagcagacacttctcagatgcctcttcaggatttattccttacctgccttcaaaatatgatttgaagcaatttacaatatagcccccaacaaacttaaaagaacaacaataaaagatagaaaaaaaaaacaattagaagacaaagaaaggcagatatgtcagggatgaatcacatgagaaaaagaaagaatggaacattaaatttagcagtgaacttcttggcaactacagaaaaaaggaaaaggaaaatacaaattatacattattgtttttaaaaaggaaaaagtaaagtttatcttcaaagacacaattttttagtagtttattataaaatacatttattttattgtttttttcattagaaacttagagaacatgaaggaaatgtcttttagtacaatttcgcagaaatcacaaaataagatacaaataatcatctatctgcctgctctaaaggctttgatactattatactcaaacttcttaaaggtttttttttgtagttaaggacagacaattcaagttctttgttgaagatgagattacaaagttatagcctttaaacagttctgttcctacacctgactttttaaacctctgctaaaggaacttaccttggttcctcgtacaagttagttacacgtttattgctaatgtatatgtaatctatttccccagcaacggtaaaatactagcccacaaaacccagtatagttactggaacatagtgagtatttgatcaatgttcattgcattgaattaaaaatataaagaaaaacgtagttagcatgcatctaagaccagcagacaccaatcccatatttttaaaatcagcttaaaaatacatatttctataacctgagcttaatatttaatctaggggaaaaaataaataaaataaagtaaaataaaaacaaaaattatagattccctggttccatctcagcactaatgaattagaatatctgtggtttgcatttgaaatctgcattcctaagaccttctccagagaatttattgcagccatactccagagtggcatttcatcaatcccaaatattctccttttataacatttttcatgtacactccttttttttttgcaaccataaatactttgtgtccaatacatgtgctatgggggatgactcctaggtataattagaagaaatattgagatgggaaaagtttaagctagaaaagggaagtcgaagtcgaaaacatagtgaaacaaaaggtagatgttttactgtggaggattgaaggagatgaagaaaccagaaggaagtttgtgcagactgctggactgtgcctgaggactggggcaagagctgcaaagctaccagtaacccagtactctctgccttatcttctctgcttctccttccttacatgcttcactgttctcaactgcagacaggcttcctttgctgctctctgcacaggggcattacccagcccctaggttacattgcctcagtgccagacatacataaacacacacacacacacacacacacacacacacacacacagagtcacacacacacttcaccaaagttctgggaatctcaacagaagcccaggggagagagctgttagtcaaattctataatgtacatacaccactgatctcattccctggccctgagacaccaggtcacatacaacctgtgcagctgcctgagctatctctgcagctgagaaggcacttctggagaagaaggtaatgctgtgactggatgcactcaaggacatttctcatctcagagttcaaggaaatggcatagaggaattatccaaagatactgtcctatggtcttgggactatggaaaccaggaggttgaaatcaacaactctaaaaccaaaacaaaaacaaaaacaaaaacaaagaaaagtcttagatgtttcactggacaaaatgcatttagcaggaaaaacaaaaacaaaacacaaaccctattattaggtagattatatttgtcattgcattctttgacatgatctgggtctggattgcagatgttgcagggggaattggattatagcatcactttctcaacacagctgttttcacttgaggtggatatgggcattacttggccaccatgacctatgttttcctttgaagcatgggagttgtctggtggagttgggtagtgttcattctcccacaaagctgttgacagctatcaatcttaggggcaacagagactctcagcttgggagtaaaggaaggagaaagaactagattattcttcctaactgctttttccttccccaagtaaaattttttttaaaaagtcattagataggctggggtggccttgattgaggccagactgcagagatgattagagcccttcaaagaaaaagattggcacaagcaaggtggccactgatcccagagctctcaataaaacaagcatgctccccggagctgcccagcttctctgggtgcattttaaggcaatatgtcttaaactttagtgcacaaattgaggttctaatttagtacatctgggggtgggtccagatactatattttcttttaaaattaacaaataataattgtacatattcatgggatacatagtgatgttttgatacaaataatatatgatggctgggctcattcctataatcccagcactttgggaggccaaggcaggaagatcactggagcccaggaatttgagactagcctaggcaacatggtgagatcttgtctctaccaaaacaaacaaacaaaaaattaaaaatcaaccaggcatggtggcaggtgcctgtggtcccagctacttgggatgctgaggcaggaggattgcttgagctcaggagggtgaggctgccatgtttgcaccactgcactccagcctgggtgacagagcaagactgtatcaaaaaacaaaacaaaacaagaaacaaataatgtatggtgataaataatgaaaagtgagaaatgataaacatttatcctttttgagtaattaacatatccattatcttaaatatttatcatttctttctgtcaggacggctcaatgtcctcctagctatttgaagctacacaacatattattgttaactatagtcattctacggtggcatagaacactggaactatgtggctgtaatttcgcattctttaacacatctctccctgtaagtttccaagtgattctgatactaatggtccatggaagtaatgaggctttaaggagcacaaattggtaacttgagaaagttagatttacaacatttgcgatccttccttccgtgtggaacagtccatagcaaagattgactccagtctgcaacaactgcactaccctcctttcacatatggcaggacttcatcacaatggtttctggttctactaagggcaataaagtcagcggattccttgtttcattagaagctctgcagtagaccatgaaacatgctcagggagagaagggggaagctgaaagagctgggaaagccagcagtccgttgcgagttgggccacaaaagaatagaggaattaacaatccccacagattataagaaaaatctggggagggatactaactagaaaagactgaaaacttctagtaaagtgaatggagcttgagaacattataatttgggaatattaatataaagaagctgataagtgctagacataatactagatataccaactaaatccacgacaaagcatctaattgaacctacgaggcagagcacgcctgcaaagtttccagggaatataaaatgattacttggacctaattacattaacgtgaaaaatgtcattgatattctctttattgaatagctaccactgttattttacagcagtgaacattaaaacaattattagagattcccaggttaattctcaatctatatgtccaatcttatttttcaattaaaatcttaatgttgtcaaccaagaattcttccaacagcttgctgttgagatatttgctatctgaagaactcaatcaaaaattttagactccactagagtgggtatcacaaaattgcagccaaacttaatcagatgagcaaagttttttgtttagcctatgtattttcataattcctgaattagaatgcctctaagcaggccatacacagtggaactgaccagttcccagtgcaggatggcaacgtagtgcatttatctgcctgaattctaaaggagataagttcacccctttcattagctcatcaatatatatatgagtaacatttttatatgcgtgtttagatgtggagttaactctgaatccttgaccaaatggagcttaaggtttagctagggacatgtgcaaaataactctaagacaaagtggagcgtacaagagatgcaaaaaccaaggcctttgagagcacagaggcaaaagcttcaggagagttttcaccaatgagctctctgaactgactactgaagaatggatggaatttaacaagcagaatggcctgtaagtgggacggtgaggagaggagaaatggagtgaagccacagatgtaaaaagtgcaaggcatcattgagaaaaagcaagaaactagaacgaagtgggcataagagggagtaacagggaaaaaagaagacacattttgttagagcaaaatgtcattccacagtagctctcctcagctccaagctccctctcttctctctgacagcaacacaggtatcaaaccccgacacggaggccgcttccctattattcctgtcctgatctctaccctcttcctaggcttgacagcttcctgatcatgaatattctcttgatcctggtcatgaggaagcagcctgcaacccctgtacaggaatcccatgaagcacccttcccagccacactcagcatcagccgccttcttctccctcctcgctgctgaggcttcgggctgtctgatctcacctctttcctaagctgtgccaggccatgccccagcacatcccaggccccaaaactggcactttcactgccccctggagtcagagcacagaggcttatcttattactcttccttgtgtcttgggtttctccagtcattgccaatcaaacccgcgggggttcctcattttggataatgattctttcctctctcagtctcctcattttaaaataaaacaccaacaacaaaaaaatgaaatccattgggctatgtcttttattctgcatgcctagttattcactaaaccctcacgctctttcctctctattccttcagcccttggatatcaggacctgggcacccaaacctgttcctgcaacagccttacccttgtcacagtgctattgcccttactgaatgccaatttatcccgagcactttcatcacaatatcctctgccaaacattttaaatgtctccatatttccccttttatcagaattagattctttggctagctttcacagaccctcataacctgacccaagttctctacagtttggtcactgtcgagttcggtgagcacagttggtggtgacagcggtcttgagcgagtatggctcttcctcatctttcaaacagctcaccactgctctgcagaaaccctttccttactccccatcagtcaggaaaaagaaatcactgatttttttcaccctcctaatttccatatacaaccttcataacattgttttttatacgtctttatttattttaatattgttttacttcgcatttgttcattcggtctttacaaactaacctagagcagggtcatgatttttggcgttttgttttactatcatttcaagtgtttcacatgataaatataccacaggcattttataagtagttactgaataatggattagagacagagtttcaatagtgaacagctggaatcagttttaaagagttatctaagaggtacaggagaaaacagaactgtgctccatgcagacttaccagagaagacgctaggtatcttggaaagaaagcttttgaccgtacgaataggaattccatttttttcatcttgcatccgtgctatgacgtcttccatctaaacaataataacataattaaaacctttataaagttgaacttttttgaaaaaaaatcagctctcataacaattttgtattcctgttttgcccaactaagaacaatgccgtattcttgcctttctagtttttgccacattaatagtttaaatactgttaaaaagagatggaggaaacagcaagaaaaacagccatgttagggcccattaagctaccaataggaattttgtgctttgaatattgcctttctcctgatttcatgtaccttggttataaaggttaagatcaaagagtgtttatttcacaaggttttagaaaccattgtcatagcacattcatgcttcattaatgttacctctactgaaatcagtgcaaaagcaagtagagccttaaaagcatctgcttgaattgcttcttcaagcaagagaatttccgtgattttgttttacaataaagttctaaaacctgcctagaaatccaggactgattgccaactactattacatctcttgcccgggtacttactgaagtgtgttatgaaacaaatacacacacatacacactctcatgcacatacactcatgcatgtgcacatacactccacacatgcacatgtacacacacacatatatgcacacaagtacacatacacgtgcatgtacacacacatgcacacacacacatatgtatacaataaaatgaatgtaacaccacagccttctgtccgtttactagattcccctttatctttgtttcaatctcattagtacactctcttttacttttacaaattgctggtaattctaaagggctgtgcttcacaaagtcaatgtggaatttagttttgaagaacattcattcattcaaatcatagccacagacattactcatgtgcttctaaacctgggagatgcagagacacacaaacatacccaagtggtagtatgggacttaaaatccattcatccatttactcattccacaaccacttatcactaactctacaccagacatatgactgggcaccgtggatatgaaaatgcatacaatacagttcctaccctcaaaaaattcagtcaatagtgacaaccaaggtgaaatctgagtaaagtatgtagtttagctaatagtgttgtactaatgttaatttcttgttttgataattatgccatggttatgtaagatattaacattaagggaagctgagtaaagagtgtatgggaattctgttatcttttctttttatctataagcctaaaattatttcaaagtaaacagttaaaaaaaacacagtctaaactttatattaatgaattatcaaatttccattggccgggcgcggtggctcacacctgtaatcccagcactttgggaggccgaggcgggcggatcatgaggtcaggagatcgagaccatcctggctaacacggtgaaaccccatctctactaaaaatacaaaaaattagccgggcgcggtggcaggcgcctgtagtcccaggtactcgggaggctgaggcaggagaatggagtgaacccaggaggcagagcttgcagtgagccgagatggcgccactgcactccagcctgggcaaaagagcaagactccatttcaaaaaaaaaaaaaaaaaaaaaaatttccatcaacatagctttagaatggttttcagctaagaaatctaatgttcttggtatcaacggatgtattactatgttgtaatcacactatgaacagatgtattactatgacaaataactggagatgtggaaagaatgggttttaatgaaacacaggtttgtatttgactcttagctcttgtaattattatctatgttctttgagtaagttaaataacctctctaagactcagttttctgatccataaaatggtgataataatacttgtaataatttcttcatagcgttcttcatgggattgcattgggcctagggtggggtaaagtattttaagggcaaatgatacaacatatataaagcctggtacatatatagaacaacaaatattagaccaaatgtccatgcacacccacgatatctggggatgcttattctccaccttcatgtttctttccatgtggaaggagcgccattaccctaatccccttgccttgtctctgccccctaatttactccaggggagctgagctgacttatcagacagaagagctgggaatgagaaactggcctgcagggcccactctttttctcttggctagaagcccacatctaactctgctgatgtagagatgcctgccctagtgggtaagcaagtctattcaggattgtgtttcaggattaacagtgacttgtgcacaaacattcttccataatacctttatcagcaatcagggtgatgttgtgacccctacgtgcctgtctttatggttatagttctcagttggctcagaaatcaagtataaaaagaacatgatgctgggcacggtggctcacgcctgtaatcccagcactttgggagaccaaggcaggcagatcacctgaggtcaagagttccagaccagcctggccaacatggcgcaaccctgtctctactaaaaatacaaaaattagctgggcatggtgacaggcgcctgtaatcccagctactcgggaggctgaggcaggagaatcacctgaaccccagaggcagagcttgcagtgagccgagatcataccactgccctccagcctgggagacagagtgagacttcacctcaaaaacaaaaaataaataaataaataaaaaagaaagaaaaaaaatgattttatcaggcctgtaaaagaccccaacaataaccaaataccaaataccccacttcttttgtaataaagatctgtaataaagatctctaagtatagaaacatgaaaatagacatactctgatgactttttattttgttactatttgttcatgactgacctgccacaatgttcagaaatgcagaataagctgctttgtcctgcctcatatcagcctctaaacccttgtattatctgcttaacggtttaaagcaggctggattagagggacatggaaacctctctgactcacactttcatctcagcacctagagatgtggcagcagtcacctctgcttcgggctgaatttaggtgcgtagctatgagtggcagtgttttctttgtatagtctcatcccctctcagttcatgggatcccaaaggagtgagaataggaggctggaaagtaaaagtgacttctgtggttgtattccaaaatattccatttttctgagtcatcatttccacaagagaaaaaaattttaactccaagtaaaaataggattggtgttctagactgaaaacgtgatcatgtacatgcattcagctgtttttatctttatccagacataatttatccgtgaaccttctcatggcctagaatgagacaaaaacaaacaaaagaaaacaacaacaacaaaatgaagaacaaagacacataaaaaaaacccctgctttctaaaaactaaaatcaattaaaaagaaaaagaaaattctagccctcaaatgactgaagggaccccctcttggctaacgggaccccagggaaaccctggaagctaagttcatggccatgatgggatggggggtgggacacacctcgttgtaccccttcctcactaaccactatcagcctttcttccctaaggggcaaacagaaactgacccttttgaaagactccacattgataatgttgattaatgacttatcttcccaggacagaacaaagctaaaatgagatcagtcattccttcactcctctctgggatgtctgctccctccattcccttttttttcaaatgttcaccttatcttatgtaaaaagtaaacttacagggcactaattaaagtctcgcaagtatgtaatcattcctctcactgttgcctcctcttttttaaggaaaatgtataaatactaaacctcctaagaacctctgggaaaaacagccaaacaggcatccataacttgtcctcaagctggctcaacaagcttcagtgattgagatttatgtctcaatcactcattttggttgtcacagtcaccaagtccacataaaaaaacacatgcatcttatctgttgatgttccctcgagcattcactcagagtctattaatttttatattaagcatgacttgaacatgcttgatggtctgttttcccactattagcaacagcaattggatgagaagaaaaatgctacaagcaagcaaaaaaaaaaaaacagagcaagttagttagacagtaagaggtatgagggatagtaaaaagcaactccaataaatatgaaaatatttggggcaatttagtctaaggccaaaagactcaggtacctcaagtatcccatatatatatgtatgtgtgtgtatatatatgtgtgtatatatatatacttacacacacgcatatatatgcatgtatacatgtgtatgcacacacatatatgcacatgcatatattcattaaaatgccattgagttgtgtgttttcacttccataagcctgtttctgagggtgaggaaactgggcatgggagaagagaacactagacgatgggcatgggcaggagagctggcatgccttgggtcaccgaggatttttctgaaggctattttctttactcttaagaagttcaaagtagatgatctgtaagacttctcctagctacaaaatgattgaagtctggaaataatcatcagcattcagaaggaggtaagtttccacactaggtcaaagagccaattccctgttacagacaaatagatgaagctattaaattaaataaaaccaggccaggctcggtggctcacgccagtaatctcagcactttgggaggccaacacaggaggatgacttgagctcaggagtttgagaccagcttgggcaacatggcaaaactctatctcttaaaaaaaaatatgaaaatgaactgggcatggtggcaagcacctgtgatcccagctacccaggaggctgaagtgagaggatctcttgagcctggaaggtcaaggctgcagtgagctgtggtcctgccactgcactccagcttgcgctacagaatgagactctgtctcaaaaataaataaaataaaataatcaaacaagaccttatacaaatgtatttgcttccaattgtcagcacattttagtttcaatgcaagacgtagttattaaaagcatgcatttaggccggttagacctgagtttgaatcctgactgtactacttacaagccatctgaacaggtgagttaatttaacactcaaagattcggttatctcatctgtaaaatggagataatcataaattgtatacatcttatcaagggtgagaattagtgaaacaatgctaattaaatgcttactatgatgccaccaccaacaccatcatcatcatcatcatcaacataattttcttccttcatcgttgtactaggaagatacggatcctttttcttttataattcagccggcaaagatgctgtagttaagtgcaaatatttgttagacgcaataaattgtcaagcaataagtagtcagagatgcctatacataagctctgtctttgatttcctgtaaaaaactgagttcatgttggcccctgcaagacaggagatttgatttgaagaaatgtcaggggaaatatttgtgcatataagcaaaggctatgtaagctatgaaaaaaatcatatttagaaagggaaatgagatggcattcacttttaacaaaatgaaaacgtctttgctgtcatcttttcttgacaaatttgcctcttgaagttatttagattaaaaattaaattaaattgagtgctgtttgcaagacttaattttttaatgcaaactgattcactatgcgtgataaaagtaaaagttaaacaagtgtattttacaaagtaattttgagaatatgtattgctgaactcattcaaaactttttatgcttctgttacagaaccctccatatttcattaactagtaaaactatctgttttcccttagatgtaaacttctggaggaaaaaattcttaccttactcatctttgcattgttaatatataaagtgtctggtccataatggaggctcactttaaaaagagaagaggggattgatgtatttttgtttaaggcatatgtttgcattttctgagagcctcaaaacaaaagtggaagttaatttaagatttggtcttgagatgtttgatatgtttttttctttgtatgtaacttttgtgaaaaatacattatcagcatcagaaatagtgacacagagtagctcagcgtagggcaggttaaaacactcttatccctcttattttttctgctctatctaatgcagatactccagcttacttgttagaggaatttcttcctttatgctctatctaatgcagagatacttcagcttacttgttagaggaatttcttcctttaatgcaagagagtaaatcagtggctgttgatgaggctgtcttcttgcttgtagatgtgacactcaagttcattgccatgtgtaagccctcaagatgaaaggcactattgaacttcaacaccctgctcttttctcaggaattcataattagcatttcctttggaatagtttagatgtcacttcaagcttgtgatgtatttcaaaaaggctcaggttaaacagttcccgcccgaacacttggcggaatgaaagaaggagcatattacacaggtccatcttctttgaagagagttactaattattcaagaggggctgccagacagggctcccacatattgatgaaaacaaaatcactgccttgaaacctttccagttctctaatgttctaaacaattatgggagtttaattaaattaacttgtagctatatttgccggaactttaccacaatatcattattattgatttcattaagccaatcgctttacagagacaccatgactgtaggcaaaacatttgttatgaagtaaagctaaaacgttttgtactctgtaattctgaaaaagaaatgaatcaatcaaaatttcagaagaagttttccaactctgccttacaaccaccattaagcacaggcatttggagatataaatgggagactaagtgggcagattgaatggcttttttctatgtgcacatactttcaaattatggtgtgtactgtcattttaagtgctagctatgaaaatgggagaaatgatcactgaagcgcttcttggatttcttgggcagttaggtggtggcaggttttcataatttaaattcgcctataactctttttacttcagaaagcctttcgaatgcagaaaatcatttacacttctgaattcatcagtgaaaacagagaaagtagagtcagtctctaatgaaagttaaattaagaataatgagattaaaatttgcaagacaaactgttttctgctgtaataattcaattaaagctgcttctaattgatatgatttttccccatgttatagtttattgcagtcagtatcttaactcagaattaattactcttttcatattaaaaaactgccattttcatgaataatcgactaaaaatagaaactagtaaaatcttattgcatgtaaatctgtcctagtttaacttaaatatagatttatttatttaaaaaacagtaactcagtgaggcatggtggctcatgcctataatcccagcacttgggaagccgaggccaacggatcacctgaggtccggagtttgagaccagcctggccaacatggcgaaattctgtctctactaaaaatacaaaaaaattagtcatgtgtggtggcaggtgcctgtagtcccagctaatcaggagtctgaggcaggagaatcccttgaacctgggaggcggaggttgcagtgagccgagatcgcgcaactgaactccagcctgggtgacagagcgagactccgtctccaaaaaaaaaaaaaaaaaaaaaaaccaacaccaccaccacacacacacacacacacacacacacacacgataacataactcatttgaaagcttagaagcttagaaacttagaaattttatccttttgtgattttgcagaaataaagtagaggttttttttctaatttatagacgtttctgcttttttttttttaaataaatcatttctctcattcatctcaaggaatataacctccactgaaaataaataaacagataaataaacaattatgctcactgtgtttgttgggattacttgggttgacagaatcccaaattcaattgtcatgaacaaagaaatgtgttgtaagtactgtgggatgtcttctggaactcgaagacgggcacataagtgggtctcataagcagcccgcctttagggcatgcttactgccccctccactctgctccttgtggtgagcccactttttcttctcggcctagagtcctctcttagttcttcaatgcacagaacagcaaaaatggctgcccttactgcttgagttttacagtttgtgaaattaaataattccaatttaaagctgttggaactttaaattatttgagctttgagaaaaatgtgactatatggcctgagcacatagcatgcagctgcaattcctgcttctccgattacagattacagtatgttactcttgtgctgtggatgattaggaaaggctgaaaggtgccataaataagagtctattactcctccttataaaatgtcgaatcagtcttccttggaatgtagtaaactataactaatcaaactcctgtaacataatctaagaattggtcttgcatgaaaaatgttgcaactctgttaacatttctgtctctacctatataagtgaaaccttacctccacacttggatgcactaaccccattcttttggagtctgtgttacccaggtggtgacagcctcaaacgttgtgctcaaataaattctacacttaatcatattttctgaatctcattatttaatgctgacaagtttatatgaacccaaggagaaattccttctctaatttccatacctgaattttggggcaaaaactttgatttataacactggaggtggagttggaaggggtgctgggcagagaaactaaaggcattcgttatcaccttattcaatataaaaacccattgaacgatacatggataaagttatatagcagaaaaaagtgtaagaaaagcagtctcaaaaaaataagagtgggtggttgctgaataatgagaaagagcccaagggccaggtgcggtggctcacacctgtaatcccagcactttgggatgccgaggcgggtggatcacaaggtcaggagtttgagaccaacatggtgaaagcttggccaacatggtgaaagccggtctctactaaaaatacaaaaagtagctgggcgtagtgacgcgcgcctgtaatcccagctatcgggaggctgaggcagaagaatcgcttgaacccgggaggcagaggctgcagtgagccgagaacacaccactgcactccagccagggcgacagagcgagactccgtctcaaaaaaaaaaaaaaaaaaaagcgccaaagaaagacaaaaattgatgcagaaaagaacgttggacagacaagtcaaacaactgaatgagatttcacagctatgaaagacagaaagacggaagtagcatgaccaaataggccaagtggttaattacattgcactcttcggcatggtaagtatttgccccgaggtagaaaataccaacgatgctaaatgtatgtgaaagagtaacttaggtttccagatttcttttttgttcctaggaggtatcacttctttaactctcaaaaggagcctcgtggctaatttttattgcagtcaaagttcaaataggagagttgtcaatgtcccctgaactatttgggaaagacttcatgggaaaagtaagattaagctgatcctagagggtaggcaggatagagagctataaaggaaaggaggaggcagagcacacgaatactttaatcaattgcttcatcttcggcgtcaagatgggaatgagtaagactcctgcacagaataatgaattctgtcagaatccttctccttctgcctctccaacttgacaattttaacctttctggaaggtgtctctgtagtcattttcaaacacaattccacctttgctatcaacttagttcacatactgcctgcttgaaattctctcttatacgaactccttacctcctgatcccacttgagctcacatcagttcgctcaagtagcaaaccccagaattaacctgggaacaagtttaaatatttcatctcttgtttaaaacttccattggcctgacaaccccatgaattttctgtaagcgaaatgaccacccaaatttatccacgatatgacgcccaactgtcattctagcgttataacttgcttcccacatgctcagcaattgctcctgcctgcctcaccttctcacatacacttcctcatgccagctgcgcccttcccttttccatctgtgcctgtggaaattcagctatacttctaggatcattccaaattgtaatttcctactgacgtccgtctttatccctccccctacctctctcatcccaacagaatatgatcatattctctgttaaactacttgagatctttatttttagtttaaattttttttaccctaccttactttacatgacttacatgtaagttatttattaacataaatatcattctctttagattataaaagctttggtaatttgcattagttttgctatctgtggcatggtccatgaggaattatcaccccccattttttactttacatacttctttgctgtgtttgtatgttcaccaacaggacgtattacttttataattaatattattttctatttgaaataattaagaattctggccgggcgcagtggctcacacctgtaattccagcactttgggaggctgaggcaggtggatcgccttagttcaggaatttgagaccagcctgacgaacatggtgaaaccgtctctctactaaaaatacaaaaattagccgggcttagtgttgggtgcctgtaatcccagctactcaggaggctgaggcaggagaatcgcttgaacccaggaggcagaggttgcagtgagccgagattatgccactgcactccagtctgggcaacaagagctaaactccatctcaaaaaaataataataataataattaagaattcccactttaatagtattaaaatattaaacgttaagttctttattcaaatgtctgttgtaacacatttgagggttaaatatcgccaactgctctttacaatatactctctgtaaacattctgtataattgctattgactttcaacaactaaactagtctacctccaaattatctctttttacaaccttttaaattcagagttaatgaacgaaattgtttacattcccttttttcttagtcacatctccaataaccctggaagtccgaatcaatagtcttatcatcggccccctttcagatggagagaccacagttcctgacagatgaaaggcttctcttgggactttttttaattgacgcaggtgcttgatttcagacaagcccttctattctagcttctggaatcaacttgaaattcagcaacctctatgtgtaacaaaaatggacgaatcattcctctaaaaaataaatgaacaatgatatttagcaaacaaaatacctaaagacaaccattgatttggatgagtgaaaaaggcagagaatgcagaagatgcctgggatttagctaatctctgagattccggcaggaaggacataaaaaaagtcaaagggctcttggctgagtttgccattttattttattatttcatttttattttattttattttattttattttattattgagacagggtctcactcactctttttttttttttgagacagagtctcactctattgcccaggctggagtatgatggtgcgatcttggctcactgcagcctccacctcccaggttcaagtgattctcctgtctcagcctctcaaatagcttacaagtgcccgccatcatgcccagctaatttttgtatttttagtagagatggggtttcaccatgttatccaggctggtctcaaattcctgacctcaagtgatccacccgccccagcctcccaaagctctgggattatgggagtgagccaccgtgcttggccaagcttgccattttaaaacattcttactaaaggaaaggggtctcacaatacctccacggagtataatagatttaaaatagctttggaacataagaattactctaatgtttcaattctttgatttaaatcccagcttctctttgtagccatttatgtctttgttgtttataaattcatacaaatatttcggaagccacttaagtttcccacctccttgggtaataaattctgtatgtaaattatctgctagttgaattcatatctagttcctattatttaattcttgcctcattcaagctcaaaagaagccccaccattttacagtatgagaatttagtgactaacaccttgtttatcctattcatggtattcgtacatccataaatgttgatccacactatctcctcctccttttcgtgagcaacagacccagtcattctcatagttctgtatggagcacatccttctacaattgtctgccccgcttgatatttgtgagggaaacctggccgaggccagataccatggttcatgtaatctcagtgctttggaaagctgagggagaaggattgcttgaggccaggagtttgagaccagcctggacaacatagcaagaccccccctctctacaagtaaaaaaaaaaatgaaaagacaagtgtaaaaacaatccagtctattgatggccactgggcatcacagactcgtttccagatattctccctccaacaccttcacacaactccaggactgatggtgggaagaacagccttatgcatgcttacttccatcctaatcctacactgcaaaccaggaaataagactgaatgtgcactgtggactaaaagcatctctgttattcccataaactgactgaaaacaataaatgtacccattgttgaaaataaggctctgtcatcatgtgttcagtgacgcagagcctagaacatttcagagtatcatgtaggtgattcttctctcaattctttcaaggctggtacaggactagtggcattccaaacacataggagagaagtttatttattacacacaatagatgcctcaggtcattcgagcttaatattcttatgaaacctgggcaggacctgtcagagtatgaaatgctccatctgaagccacaagagaaagcactactctgcttccactgagatgaaacatgaggactttggattaagtgtaggcagaagggctaaaaatatatatttttaatgatgtgatatcaagaaatgttacttaagtaatttatttttatggtaacatacttataaaatgcagcccagagatgtctctgggatggtcttagtagagttcttccaagagtaattaaagggatgacctcacagccatcaccaccgtatatatgatagtgctttgcctgggtccatccagctggcttagtccatgaaacaataccatgtttctaactaccattttcaaaatgaaattaaaaagggattataacctgaaggtagggcaaaagcactttaaaaggacaaaagcatcctcatgccaatgaagaagatttatttcaggtgtacacactaaaactaaatataagtatggtgatttatttgtcttaggtgtttcatggttttcaaagttttaaagtggtttctgcagctgctgaatctgacctttttctctgtgtaacactcttggtttacttattttgtacaacgatttttaaatttccagttcctagaattcttttaagatcaatgagtaaactgtagaagggcaaaaggaaaagatttctactttaattgtacccttgctagtgttgccgattcaaggcactacaacgttaagatggattttatttttcagaagtatttgaacagtgatgtcgatctttctaacccaccgaacaattagttttaaagcagagaaaattcaatgtgacttttctgacttgccttttatatggggatttggaaaaaacacctccttctggctagtccatctatgaaagaaggttctgcacaggacctagtttcaactactccttcattccacactgttctcaagagagaaattaggatgaatggtggacgaattcatacaaaatcccaaggcaaagtaggtccaagccttggcacacaaacatataacttctagtccaataactggctcttttatatccaccacaattttgttttccccacgagtgccaagaaaatcagaatgtctagttgccttcttcctgacaacgattctcaatgatcctatgaagaaatgaataaaaaataaaaaggtacctcacttattactagatatctgtgactattatcttatggctagaacacgaacatcagaaggtcatggcagtgatgttgaattatttaaaactatttccccatttggtaattgttaaagtcatagagacacctaggtagtttgaaatgccctccattgaaagccagcaatttctatgtgtctccaccagccaagaggaccctgtagagctttactttctatagctggaataatgaaaaacaataggttttttattgttttaaagaaaaaattaaaatactgactatatttttaaaactgcacctgctcccttaacgttttgatactcgcatggataaacaactttgataacctctggtgtaaagaacgtggcctttgttgcttagcagagccatgtgcaaatctcaggtccgtcatttgatgaatgatgttaggaaaataatttagcctctctgggctaggtctttgtactccttccctataaaatgagaatgctacttccttgataaaacatgtactttacagcataagttccccttccttctttctgtgcaaactctgagatgacgctatttctaagagtgcaacacttggaaatgaggtgtcttcttttctctggagctattaagactttctttattccctacttatgacacactctgtattacattatagtcatatgtgtacatgtcttatttcttttgttctcttttactgaaagtttcttcaggataaatattagtttaattacactggtttaatcactgtatcctgaatagtatcttttgggaaactgagtatacagagacaatggctagaccacatatgagcacagaattctgacccacagcccctgcaaccagcctgggaagccaaaccacaagctcagcagtagtaagtccaaaatggtcaagactcaggcaatgacaaccagcttccctaatttttgcctctgcctataactctggacaaaccagagaaagctagacactcctcaatctagttatattagatacccactttcagcttccccatgcaacaacctccagtcagagctcgctctttctctctctctctctttctctctctttttattataaagctttcccactcctctgcctgcctttgagtctttgccagacacaagtggtggtggacgattaccttgctacagcaagtgctgaatacatagcctttctttgttttcattttggtgaccttcatttacttccacattaaaaaaaaaattcatgtacatctcactgcattcccaagaagaatctggggtaaatccttgtccagaattatgtcttttatagaagcaaagtctccttccagttctaatattctgtgactaatagatgttgaggtcgaataaaatgctgatttgttgaacaacttttcagaaatagattattcctgtgtataagaattgtcaaaataagtaattcaaaatctaaactgttgaaactttcccttattttgagccctaaaagaatatgattatggggcctgagtcatgtgacaggcagctgtaacctaggcagctgtaacctttgtttttgtgattatagattagccttcttcctatattgttttgtaaaatgttgcaaatgactgaagggcaccagggaagaccctttccctctacgctgctgatcttcattacagattgactttcttctttcctttctcacacaaggactttacttgactatcacattgtctaagatggaatgccaaacatacttttaaattggaaaggaaatgaaaacaagctttacagaaaagaaaacaaactgtaaccaatcattacattgctgtaacccataaaccagccttgtatagaaaatgctgtaatcctgttaaatttgttttctgcttacataagcaagaccttaactttttacttctgagcactgaccccatttctctggagtctattttctgatggccattcccacctttgcactggaataaactctttaaaactagatctgatccttgcagttatttcaggttgacagaatggttcatgctgaacctccgaattaagttgttggtttaaatttttatgcaagttctaaaagaccaaattaacctcccaccacatcatacccagcaatattatactgcccagttaagagccatgggtataaaattacatgatttctttcaggaggcatttatccttctactaaatatcagttcattttttcaaaaatccactcgtccagctttgtgggaactgaacactaagaattctcaataggggaagaaacaattgtctcccccattgtatgtgtattgatttgtaacataacgtggggcgaatggtttgagcctggcttctccttctcttcttgccaaccctggtcccttgttttgggatccgtttcccttggagaatataaacattctttatcccacttcttgaaaggccatccttgtctttctagttgatgttaggaatgaactgacatggacgacaatgactatgacctatgtaggaaatctgtgaactgagtaagtagtcatatgaaaccaaatcttatgtgacctattgatatggtttagatttgtgtccccactcaaatctcatgtcgaactggaggaggggcctggtgggaggtgattggatcatgggaagggatttcccccttgctgttcttatgttaatgagtgagttgtcgcaatatctcatggattaaaagtgtgtggcacttcctccaacactctcgctctctcttgccaccacgtgtgcttcctctttgccttctgccatgactgtaactttcctgaggcctcccagtcatacttcctgttaagcctgtggaactgtgagtcaactaaatctcttttcttcataaattacccagtcgcaggtagttctttatagcagtatgagaatggactaatacacctatatttacactactctaaaacttgcattatacatgtaattttagaaatttttattgtggaaaatcttaaacagatacaaaaataaatagaatacagtgagccacaggtactcatcacccacctgtaaaaatcttcagtttattatgccaatttatgttttaaaaggaataccaactctctctatgaaaagtatgacttaggaaaaggtaccgtatataggtttttctattagtgtgaatttcccatgcataaagtggttgctctctcctagcaggctctggctgctggcttcccggcctcccttaatgctgtggatacctgtgacacaagacctggctttccttaatgcctatctaacttctttatttcctataagactccaaacttatgaaaaaaagagggtgacagacaacagttcatatactaataaagtaaaatttgacctctatttttatatacattctgtaaattttttttagttgacatataataattgtacatagtcatggggtacatagtgatgtttcaatacatgtaatgtatagtgatcagggtaattagcatatccatcatctaaaacatttgtcagtttttttgtgttggaaatgttcagtatcctccttccagctatttgaaattatatgatatatgttattgttaactatagtcatctgacagtggtatagaacactgtaacttatttcttctaatacacattatttaatttactcctaaccaccatgtaatatagataatgcaatcatgttaatcattcctttttagagataagagagctagggttctgagaattaaaccgatagatgtaaggttacacagttggtaagaagggggccctctacgaggtagtatatgggggcacatttgcaaagcattacaatggaagattatatttcaaaaaaaacacggcaaaaatgcatgtcagctttcttttcaaataaaatataaatgtccttgaacacagtccactctcaggggaaatttgaggaaaagacatatcatactgactatattccatttgattgcacacagtgatacaatcctttacatttcaaccaagacattgaaatgctcctacttcaagttctgattgttcacatgcattctctgggaactgctgcctggatgtacaggattttttaaactatgcagaacctacatcattcattctatatggcagttgttgaaataaacgtttagtgattctaaatacctcactaaagtagctagtacttattgtgaatctaccatgtagaagtgctgaatgcctgttgtggattgtggatggtgacaggaaaggaggtaagaaatgacttcctctgggagggatctttgatttgtgctttgaacactgagtgcaaatcagataaactgagtggagggacttaagcagaactgcagcaatgagaaaactcctggttaatttgacaggaaaagattgtttgcagagcggtatctgtgggataaagtggaagagtgtaatgtacaggcttgagtggaaatagaacatggataacaaagaagaaacaaccctaggaaaaagtaaagctgcaatatatttcttatcggattaatctaagatcagtgtggagaagccaacagagacataaaggacctcgtgtaagaaatcagacaatggcactggggacaatagccggtaatgcagagaatcaagcaagataagcatgaagtcagaatccaggcataggctggactaacacaatccttacctgcaaaatctgtaaaacttttgatagcaatctgcactaaaataaacatttttcatcatgacccagcacatacatgtgtattccaacatacatagatttaattgaaacaaaagttttacaaaacaatagctattctttctatggtagtgaagcctactatttttattctattccactgaataaaaattaaaatagattttacaaccttcttaaatgtttttacaacccacaactggaacatgattcaaccagcagttcataagagactattgggtacattccatgaggaaataaacatacgcaagaagtttccatccttaaacaagtttccacccaattaaacaattaaacaaaccaaccaatcacagtcctcctctggcaaccatcttatctcattttatttaatgccaaacctcttgccttccgcaaagagctgtctaacctcatagttttaaaactttttcgtctcaggacaactttacacttttaaaaattattgagaatcccaaagagattttttttaaaaaatcaaataggctgtacctattaatatttaccaattttgactaaaaacaaaactatcatttgaccctgcaatcctactactgggtatttacccaaggaaatcattttataatataaaaaagacacttgcactcataggttcatcacagcactatttacaatagcaaagtcatggaactaacttaaatgttcatcaacagttgacagaataaagaaaacatggtatataaacaccatggaatactacacagtcttaaaaaagaatgaaattatgtccttcccagcaacatggaggagagggggccattatcctaagtgaactaacttagaaacagaaaaccaaataccttttgttctcacttataagtgagagcacaacaatgggtacacatagacataaagatgaaaatataatagatactgaggactccaaaaggaggcaaggaggctgagggttgaaaaattaccagttgaatacaataatcactctttgagccacgggtatactagaagcctactttcatcagtatgcaatatacccatttaacaaacatgcacatgctcccctgctcacccaaaatgtaaaataaaataaaacaaaacaattaaaaattaaaaatttaccagctatgaaataaaaaattaaaataatcagtaaaaatatatattaattacttcattaaaatgataataataagtacattacatggtaacatgaatatctatcacaactaactatatttctcaaaacatatttggtaagaggaatgacgttattttacagttttgcaagtctcttccatgtttggcttggaagacagctggattttcacatctatttctgcattcaatcagttgcaatatgttgttttagttgaagaaaatccatccttgcacagaaaatgctttgaataggaagggatttttagtagccttatcaaacaatgaatgatactcttctctgctactataccaaaactccacaggtagtagtcagtgattacctgagatgtagaatctgaaacttttaacaatgaacttttcatactcctactgtactaaaattcattctcctattttggactttgaatggatctttttacccaggaatggcatgtactgatgacttggaaaatactgatgcactgagttatgcagatctcttaaatgctgacacaattcatcatacaatatccaaaatgacatttgttaatatcaccactgatacaatgagaaaagccttttactattggaaagctcccaggctcatcgtgacaatcacaagttttccaaaattataactttcactcacaagtttgttattggcaactaatactgtcagttgttttccttgaaatgacggtcttatttttttccattaaaaaaaggtgtgccaaatattcatgtctgaaacagcagagcttgtctttcagttattctttcaagtaacaatgactagctcagtttgcaactcaaataatagcacatcacacttttgtatgcagcgccttgatctcttcaaagccatcttccacactgtggtccgagtggcgtgttgtaagtaaatctcctcatttttctctcttattgaaaatacattggttttctcttttgactttaggataaagctcaaagtacttggcatattatgaggccctgcccatcctcaatgcaatccccatccttcccacactggagtttttaatcattttcccaggtgagccatcctcaggcctctaaggcattgcctgcctacctggttaaaatgggcttaccttccaagattctgctcaagttcaggggctttgagaagccttttctcatacaccttgctctctacataccactatcatcataggtctacttatcaattaatgttgtatttgtaattttttttgttttgttttagagacagggtcttgctctgttgcccaggctggagtgcagtggcactatcacagttcactaccgcctggaactccagggttcaagcaatcttcacgcctcagcctctcaagtagctgggactacagatctgcaccaccacgcctggctaatttttatctgttgtagagatggagtcttgctatgttgcccaagctggtctcgaactcctggactcaggtggtccacctgtctcatcttcccaaagtgtgggaattacaggcatgagccaccgcgcctggcctaaactgtgaaattcttacagggggaaattttgtactgtacagagatctttttaccagtacacatatgtgtccaaaatgatctcaggcctagaaaagccacggcctctagatagagaggaaaatagggaaactagctgacaagtaaagggtcactcctgatagcacagcagcaggctatggagtttggtgtccacagtttaagaaatggaggatagagggtttagagtggaggtgcacgagtgaggtgcattttaaataggttaagtaagcctgcttcacactacaatttgaactttggagaaagactcaaggcgaggacaccgtacctatatttagaccccagaagaaagctttgctccaggtctaacaggttatctctccatgagatagcctccacttctctctggattatgatctcacttactccttactccattactccccttgcctgggctcctgactctgaagattgcttcacagatttcaacagtaaatagatgatatcaggaaaaagaattcagaggccaaattgtaaaatattgggtgaaaaaaagtactggacagatgtcaaaaacctttcagagattttacttttctaacttgctccaaatatctctaaaaaggaattatggtttgcagtgcttccaaaagagcatagctgcagaaccttgttttgcaggagaatttcaagggctaaggtttagtgcaatacacctgggagagaccttgaggtatgtatgcatctaggttgagcgatgaaaggacaacaaaaggaaaagaaacaaaaacaaagtctctaaagagcagcaacaataaaatcatcacttgaaaacttgtttgaatatgtatgttataattgatgcagcctcacataaaaggtgacaagctatggttccaggataatatgtctgggagtgagggtggatgacagagagggttgtttggaagcttataggagaatatactgctctaaatttcttatcatgataaacttggaactttgaagtttagagaagaaagagtttatatatatgctagtctatccacctgtgttgcaattgttctttttttttttttttttttttttttgagacagggtttcactctggtacccagtctagagtacagtggcaagaccatggcttactgcagcctcaacctcctagctcaagcagattctcctccctagtagctgggacctcaggtgcgtgataccacacctggctaacttttaaattttttgtagagatgaggtctttgctgtgcaggctggtttcaaattcccgagcttacgcatttctcccgtcttagcctcccaaaatgctgggattacaggcatgagccactgtgcccaggcttaattctttttctgaaggtaattattaagttcttttccaagactgctttattacttttttgaaaaatcacttatacattgcttttgttatgcaaatgcagctgctatcttcagtgacattgttcagtaagttcacgcaaaagtaattcaacccttggcacttcattcatcctgttggcaagctgaaggagtagagagtgaaaaattaaatgaatatgtgatctgtagttagtacctataccttctatttagcattctcgttactctccccaatctggatgcctagtgtgtaccacagataccacagggttatgtcctgataaactcatcataagttgaaaatattgtaagtaaaaatgcatttaatacacctaactgtctgggcatggtgtctgatgcctgtaatcccagaactttgggatgctcaagctggtggatcacctgagatcaggggtttgagaccagcttgactaacatggtgaaaccccatctctactaaatataaaaaattagccaggcacggtggtgcatgcctgtaaccctagctacttgggaggctgacgcaggagaatcacttgaaccccgagaggcagagattgcagtgagctgagatcgcgccattgcactccagcctggccagcaagagagaaactccatcacaaaaagaaaaaaaaaaaaaaaacacctaacctaccgaacatcatagcttagtctagtcttaccttaactgtgctcagagcacttacattggcctacagtttgacaaaagaatctaagacaaagcctattttataataaagtgttgaatgtcccacttgatttgttgactcctatgctgaaagtgaaaaacacagtgatcatatgggtagtcaaaatacggtttctactgaatgtgtatctctttcacaccacggtatagttgaaaaatcctaagtcgaaccacattaagttggggaccatctgtaaacataggtgcttgataagtgattgtcagacacatgaataaatgagggaaatttcctgctcttgtgcaatcacagagacctctggaattcaacatagctactctcacaagtgctcaggaaccctagaggacatcaacaggggtggtgtcaatcagggctttttgatgacttgccccagagcctgccctgctgcagaccccaggtccttagcctcagcaacacccttggctctgaggacttcagtgtggctggaccagcagctccctctttttcatcactcattcattatttaatcagcctatctacctcaccaaggcctccccaacccagctgctcctttctgtccataaaataactgccttagttcaggcagttatggctgggtgaagcagagacaatgccactattcccaccattctaattatgacccacatcctggcaagtggattctccctaagatacaatcactcaaaggctcaggggcaagaaaagagaacatgggccggacacggtggctcacgcctgtaatcccagcactttgggatgccaaggcgggtggatcacctgaggtcgggagtttgagaccagcctgaccaacatggagaaaccccgtctctactaaaaatacaaaaattagccagctgtggtggcacatgcctgtaatcacagctactcgggaggctgaaggaggagaatcacttgaacccgggaggcggaggtggtggtgagctgagattgcaccattgcactccagcctgagcaacgagagtgaaactccatttcaaaaaaagaaaagaaaagagaacatggctttaggttttggtatcaaataagcccagaataatgctcaacccagaatgatgcagacctatgtcctagtcatggtagcatgggactgggtatccccgccatgctgtccaccctcaccttagaagagggcctgcccctggagaagcaggagaatgtgttccctttggcgaaagtttgaccaaaagaggaagaaaaatgaaccaaacatactcagatatttttctgaaagttactgatgaaatgaatcactccaatttcttaggtcaagcattaataaaggggtggggaaaagccagggatgtgcttagagagtatccctcttaagaagaaccaggatgggcatggtagctcaagcctctaattccagctctttgggaggccgaggcgggaggactgcttgagaccaggagttcaagatcagcctgggcaacattagtgagacctcgtctctagaaaaaaaaaaaaaattagccagacatagtgctgcacgcctatagtcccagctacctgggaggctaaagtgggaggatcgcttgagcccaggaggttgaggctgcagtgaactccattgcaccactgcactccagcctgggtgacagagagagaccctgtctctttgaaaaaaataaaaaagaaagaaaacaagaaccagaaaatgcatttttgttttcttctatcaagctttataaaagcattggtcaacagatggaagagtggttttgaggatagccctattccctcttaaggctgggatagagggttagggatggcattcaaaggaaaacgtctacctttagtacaaggcggttctattaaaactgtggaggcattagatggaagccagcagtaatgctttagaaccattctgggcttcctgcagagtggtgtctgctgggacctgaatcgtggcaggagatgcccagtgcacggggcccatttggtcaccagcagaaacaggaagggccccctgggagctgagccaattgtgtggacatgtgagacatatctcgggacctcccaggagagctatggaagtagtgataggacactgtaggcgctgcaggtaggcagaggcaaaagccagcgaacttgttactcatcaatggattctctctgtactaactgctgaggcctgaagaaacttggttatatacagaagtgtgaggcctcccttggagactaaagcatttgctccctcccaagacattaggcagaaaatactacttgggatggcaggttgttttgcacggtcatgcccttttacttcatgagctataatctagatgtcagctggggactctgtgtcctcatggtatatgtaggattgctttgaccctcccattggacagtgtgaagaagtcttaagccaactggagatttgtggtcattcttttcatggcttagctctatccacacaggcggtcattttctgggcctgcaccatgcagagtccaaactcagttcttccaccagtctccataacaatgctactcgctctaagcattttatgaggtttcctagaattcatgtaatatttaaggggataacaatgagagggctatatctcactgcacagtattccaatttctctaggtctttgaccctttttcctccaatcatctagatacccgacatgcacaaagacatggacacacacacacacacacacacacacacgctgaattcatcctccctttgatccacagaaaaccaagggttcctcctctgctctcccacagaacagcatccctcccactcagctttcagcttctatcctaaatatgctctgcaaggaatttgcccaacaaaggcacttctctagttagaaaaaaattatcatgccagttgctaaaacaaaaaaaacactctctttttctaaactaatttagatgcatagtaggtgcttagaaaataataagtgtgtaaatatttattactctaagtaaggtcctcttcagggtgaccctgtacagaagcagcctggggctgagatactccctatctaatttataaaggatcagggcaggcatacattaaatccttttttctacctcgatcttatttcctcttaggaactgaaagtgctttcagacattatttcagtaatccttgcagcttcccccaatgagaggaaaaaatgcccttatctccagtgcgcagatggagcccagagagatggaagttaagtgactcccaaggttgcccacagggagcacagagaagaagctaagctgcgacctggagtcttggtgaccccgttctagagttagaagataacgttgccttacaaagagttttcaaatgtggcagcttttgctctttgaaatgggaataattgaggtttcccatttatatttatttatttatttattattattattattattttgaggcagagtttcgctcttgttgccaggctggagtgcagtggtgcaatctcggctcaatgcaacctccgcctcccgggttcaaggaattctcctgcctcagcctcctgagtagctgggattacaggcatgcgcaaccacacccggctaattttgtatttttagtagagatggggtttctccatgttggttaggctggtctcgaactcccgacctcaggtgatccgcccgccttggcctcccaaagtgctgggattacaggtacaagccacagtgcctggccccatttatattttttgctctgtaatggggcatgggagttcatgcaacgggctctagatcaagcctgcttgggtcaaatgcgcagctctgctactctctagttactgaccttgggaaagttactcagcattttgttgcctcagcttcagcatctgaaaaacagatgtgctaaatacaacaatatccttctcacggagttattatgaggatcaaatgagtttacccctcctacctccagccccccatacacccactagagaggttaggaaagtgcccggtacagagaaatgctacataaatgttagctataattatttctccttttcgaattgtgcattctttatttagcaaccttaagttgattttttttttttttggtctaggtgacagcattgcctaactatagaaaccaaccttgtagagtcctaggcatataattaaacctaatatatcaccatactattgttcacttctttctttccttccttccttcattccagaaacactttccaagtgcccactatgtgaaaggtacggtattagattaggtacagtagtaaaggtaatttagaagataaatttggccttagcatcttatggtctaaggagaatatgcacataaacatttaaatttcaactcaatgtcaaggtaatatcatagagagaatccagaagaagcaacatctaattctgcttgatactatcaggaaagccttacctgaggaggtaactgagtcttgaagtagaaataggagttattctgacaaataaaaaatccttgaaatgtttgggcaatttgttcagaatacatattttttaagctcacatacaacaatataaaaagtaaccatatattagtgataaagcacgtctcaacacattttaaggattgaagtcatacagaaagcacaattctatgaagctaagaataaattactaaatccgtcaataatccctactcgacagccatcattctcagcaaactatcgcaaggacaaaaaaccaaacaccgcatgttctcactcataggtgggaatcgaacaatgagaacacatggacacaggaaggggaacatcacacaccggggactgttgtggcgtggggggagcggggagggatagcgttaggagatatacctaatgctaaatgacgagttaatgggtgcagcacaccaacatggcacatgtatacatatgtaacaaacctgcacgttgtgcacatgtaccctaaaacttaaagtataataataataaaatttaaaaaaagaataactttccattttatcaattgaaattaatagaagtaaaagtttaaatagtgttgactacaaatattagtatatagatgtatgtatttgatgtaaaaacatagttttggagattattctcttcaaatgatttagtatatttcagaaagataagaggatgataaatttcaaccaaaaataataacactgagcttttaaaagtatacttgaaaaaaaagtacagttgcatagatttgaagaggaaatatagagcagtatgttatctaaaaagttcagaaaatgggtcgggtgtggtggctcacgcctgtaattccagcactttgggaggctgaggtgggtggatcacgaggtcaggagaccgagaccatcctgactaacatggtgaaaccccgtctccattaaaaatacaaaaaattagccgggcgtgtggcgggcgcctttagtcccagctactagggaggctgaggcaggagaatgacgtgaaccgggaaagtggaggttgcagtgagccgagattgcgccactgcactccagcctgggccacagagcaagactccgtctcaaaaaaaaaaaaaagttcaaaaaatggccaggtgcggtggctcacgcttgtaatcccagcactttgggaggccaaggcaggcagatcacttgacatcaggagtttgcgaccagcctggccaacatggtaaaaccctgtctctactaaaaatacaaaaatttacctggcatggtggcggtgcaagcatgtagtcctagctaccagggaggctgaggctcgagaaacgcttgaacccggggcggaggttacagtgagccgagattgtgccactgcactccagcctgggtaaaagaacgagactccgtctcaaaataaataaataaatttaaaaagttcagaaaatattttataatgtcaaaaatataaattacacagtatatgtatatatgtaaatatatacaaataatttacatctctataaaatatttcaaaattattttataaagcaacttcccagaaattgagtatttaaatgctatttggacatgcagaataataggcaaaaaaaaaaaaaaaaaaaaaactcttcagaggaataagtagggaatttcatacaaaggggtgataactcttaagatattttagctttggattaatttacatttccctaccccgtaatgatatgctcccttggggctagaaagaaagcaaattaaataccagttgaacaactaaattgattattatattgatatcccttcttcaaaatgttaacggaaggacaactactatttatacacaattagcatggaggagagacgtaattaaacataactttagataatttctccaaattatactcctctaacattttgaaaaagtttttaaaacagaagtgatataaaaacaggtgagcttcttaccctcagcctccatgctataagtaacactgaaattcaccataagattttcttgcaaaatgccataaatgaccttgcgtgtttaagtgtaccactgaggggatattggctactagaaacaaacaaacaaacaaaaaaaaaacggaactcaaaacacttcaagcagtaaaaggttttttgtttgtttttaaatttcacaaaatgaagtaaagtcccgaggcaggatgatttcagatttggttaagtcagattctttccgtattctgactctacattcatcagcatgggaccttcccagccacgacattatcacatttttacatgcctgtgcccaaaggcaaaaatagcgtcaacctcttacttttccttcctctaactagcaaaaaagcatcgccagcaccctcacagaagaaatctctttaggtcacaacagctagaattgcattaagtatattttataagccaataatcaccggcagagagaataaaacagacataatcaaccccctaaagagcagcagttctcaaacttgagtgagcaccacagttacttggagagtttattaaacgagatttctgggtggagcccagaaatcagtaggtatagggtggggcccacgagtctgtatttccaaaaaacttccaggtgttactgatgctgctggtccttctacaaaccccctgcactgccctaaagcacgtgggagcatcttagcaaaggggtgggggaggtggctcaggtaatcaaccaaagtgcatctgagatctaatattattttaaaattgcttttcaagaattcctattacttcaaattaaagatgtaactgagtgtcttctgagtattttagaattgcaaattttgatattctaccatcactatgctccacctctctgaagccattactagggcaaggatatagtgagaaagtttctgtcactgctaagcaagtgcatccttcagattgccaatgtgtcattgtagttggagctattaaacttctatgtggcatgaaaattgtttggctaactttaaaaaggagaaaaaaatggaagtggaggttagaatttttctagcccagcaagaacccacttggtaaccacttttagataaaaagcccaaaaataatatacttcaccagatgttcctttaattttccagggattaatttgagagtcaattacctattttaagtgattaacataaattaaaaaaaaaaaacactaggctctgaaccaatgcttttaactgtatgatggaccattgttcatttccgatacttttaagaactaggatgattttgacacattaaaaaatgtcctggaatgaatttgctattctgcttggcaacatttgaggaagtaaatactgctacaaatcctttaggtagctttcaattgtccatgtctgttagtgagaagagggacagtaagaaaaatgctaaggtcaaattcactcatgacttcatgccaaaaaaaaggtatttctgagttgataactctaaaatctttttctaagtagggacaagaattactaataacaaacagtggaaaacatactgaactaaaacacaaaatatctgaattttacaggtcatttaacttccctgagcattgctttcttatctgaacctctaaggattggatttggtgtttggtttcttttttatttttataacatccctttcagatataatccaaaggtgacatctcctttctctgtcctatccatctttgatgatatgtgttaataacagttaaatgcaaaataataggataaaaggcttaattacaaaaaaaaaaaaaaaaaaccaagaggccagataattctactctggaagaactggctgtaacatcatgatgatggcagcaatttagaaagccacattaactttgttacagagatttatttaacgccagtttgaagaatgacgtctttatgccgatgacatgattcatttttttttaatgagtaaaatgtgtttttctccattagactttactctctgtaccttgaaaataaaaatacctttccagtgtcatgcatgagtcatattgattctcaaattaaactaaacacccatagcacataggaaaaaaaagccaaatgacaatttagaaatgtaagggaatttgaatgtctactcatttacttgaatctaatcattaagatgaggatgttatttcactctttctagaacaatagttttccaacttgagtttgcatcagaatcaccaacaggaccagtaaaaacagacagctggacccaacttccagagttgccaagtcagtgggactatgtagggcctgaaaatttgcatttttaacaatttctcaggctacactggctgatgttgctggttgggaaccacactttgagaactactgtttgtagaagactggtaaaaattggtaggtgtaagaaagatattctttttagatatatgtctgggagctgggggcaaagtagaaaagcatttaaaaagcaaaaatgagagacacctgaactgtcatgcatttaccagaattttctctcataacgtggcagccttcactgtcctctttcctttttactattctaaatcaaaacattacaaatgtacaagctggaactgattatgcataatagctgatgttacttcactgattaaaaacaaaaaagcaataaactttggctccctctgcaagctgcccataataaaatgcagaggaaatatttattaatcaagcaaagactgaaagacatttcgttaatggtctgcctcatcacatcagtttgaatcacattacacatcccgttaagaagagatgatgcttaaaaatacagaaaactaaatgtggcattatcatccatcccaactggaaaatgtgatggattgtccttaatagaaagagtggtagtctattcatgtggtatgtctcgcaaaggaccgccaggctccaagagccaagtattctgatcactttttccttaatgagaggctcccataaacacaatttaatcctctttgaaaacctgagggctattttgtgtttaagtggcatacacagagatcattaaaatgtaaaagaactgtgcagggaggcccaatttttttccaggtggccatgcatcagaattttgttagaatgtaacatggatttgattgaatgattctcccatttccacatggagagtggagcccagagaattgtttaatcatgtatccatgattcaatattcatttatggagcacctatgctgggccagaggtactatgagtggggatgacaggatggatgtgacagacaggacccctgtccccatgcagtttacaggctatatcagtaattaacaagaactaaaatacttggcaaagaggaatgcttccatcaatgtttgtttaaattaaaggaaaaaaacaaaccccacaacgaaataatcaatacagttgtcacaagtgcacaggacagcatgaaagcccatgacacatattttggagaagaggtacttccattttttttggtgggggaggtacattagcctcaaatttcacagaatacatgcaatctcaaagttaaaaaatgggttttactgttaaggtctgtcaataattcaacttattatttgtttgtttgtttgtttgtttgtttgtttgtttgttttagacggagtctagctctgtcgcccaggctggagtgcagtggcacaatctcggctcactgcaagctctgcctcctgggttcacgccattctcctgcctcagcctcccaagtagctgggattacaggtgcccaccaccaagcccggctaattttttgtatttttagtagagatggggtttcaccgtgttagccaggatggtctcgatctcctgacctcgtaatccgcctgcctcagcctcccaaagtgctgggattacgggcctgagccactgcgcccggcaattcaacttattaatactagaatacattttctacagaaaaagttgtgaaaaattgtgatataattgtattgtagtacattgtaaaaattacaatacaagtgaaatgctttttatttacatttataaagaatagaaaatgtaatcataagaaataagagaaaaaccatttttacataaaattgaatataaacagcaataaatgaaatcgactatatatcaatttgataaaccacagagaaaaaaataattatttcaaataatttttgaaaatagttctttgacccattttaatgggatgtataagtctaagggcaaaaaaaaaagaaaaggtctgaaagcataccttaaatttattaatgggtttgttagtagtgatattctaattttgagacaatattgtagaaaactaaagagataggttgataatattagccaccataattttttttctaagggaaaggagatacaaatataaaaaaaaagaaaccaagaaaaagaacactcataatattaattttctcccacttaatttttctgtaatactaaatttgaattgaaaaatatagtgtgaaccaaagattataaacgtaatttcccttagggtttctactgaaagggtttagaaacattgacacagtagcaacaagcaaatttagttccctgatcctggtttctaaataccattccttacagaaacaacaaacaaacaaaaaacaaaccagttaataccaagtttaggtttggtcaaggtgaactggtgacaatttgttgtgccaaacactaatttaaatcaaactatgtgaaagaattcaaaaactagcttcaaaaagcattcatgagttcacaataagaaacagggagagagagaggcagagggagagaaagagagagagaaagggagacagagaatgaatgagatgccctccagcaaaggaaagcagtaagtccacgacatcatctatccttgccaaaatgtctatcctggatctaataaagcatcccatcctgcactgcccaatatggtagccattagccacatgtgactgtttagatttaaatttagaataatttaagttaaacaagttagaatttcttttcctctatcatcctagccctctcacatatggctggtggctactgtattgggtagcaccaacgaagaacagccatcctcacagcaagatctgtcgggcagtgctgctccagacctatcttccaaattatatggaaaccaagaaaccaagttaaatgacactacggggaaaccatatgacaaatccagactgacagaatgccgtgggacttctactagactattagcctgaactcttccaaaagtaaattgtgtttgtgtgtgtgtggtgtttgaacacctacatatgtatataaaatgcaattattattgtatactacaaagatgtaagagaggtaacaaccaaatgtaatgcgtgaatctggactgaatactgaattagaaggaaatctggagaaatctgagaatagaatggatattagatgactatccccacacctacgccatagaagcggaagtcactcttgttgtttataaaaggcccacgagggaaagtgccctactttttcccagagaggggaggggcttgcgggaaatgaatgggagagagttgaagcagagtgctgagaagagggaaagatttaccataactggaaaggaaaaggagttttactagttcctcactgaaagattgtccccggggcctgaaagcttgaagagatgagaaactcctcccctttcaggcccagtcccaaggcgcaaggccacttacagtaatcagcagcgtgggtcagcaagacagcggaagcaggacgacagccggccggaagacacctaccccggccggaagacacctaccctggccggaagacacctacctctgaagatggagaaggaggccgtccgggtactacgtagcagtcaggtcagtctgggacatttcctgtttacagaggactataaaacccctgtcctgtcctcatttggggctgacgccattttaggcatcagaccgcctgtgcccaggcgctcattaaaacagcatgttgcggccgggcgcggtggctcatgcctgtaatcccagcactttgggaagccaagacgggcagatcacgaggtcaggagatggagaccatcctggctaacacggtgaaaccctgtctctactaaaaatataaaataattagccggatgtagtggcgggcacctgtagtcccagctactcgggaggctgaggcaggagaatggcgtgaacccgggaggcggagcttgcagtgagccgagatcgcgcccctgcactccagcctgggcgacagagcgagactccgtctgaacaacaacaacaaaaaacaaaaaaagcagcatgttgctccacacggcctcgtgttgtctgttggcgtgctcttgggttcgagctgagaaccttacactcaccacttccgggatgcctcccctatctttttgcaactcttttttgagggaataatggcactgggtttacctagggagaaaggatactaaactctggggctcccaggtttggcaggctcttgtggaaaaaaacctgcccttgaaaaacccctaaccaaagagctttgaacaagatgatctgagtgggaactccttctcccacgtggtgtggccggcctcgtgtctattaaactctctactacaatgtcagtggcctttttttattatttttttttgagacagagttgcccaggctagagtgcaatggcgggatctcagctcaccacaacctccgcctcccgggttcaagcaattgtcctgcctcagccacctgaccagtagcctttctttatgcagtgacaggacgaatcccttgggtggttacatgataatgacaaaaaaaaaaaaaaaactagtttgttattctaagaaagacatatttgaaaaatgagaaaatttgttgactgtggacaataaaagacagtgttacaaacaatatatgagtctttttaagaggaaataaaatgtatcaaatcagatctatcgtccaccacatccctccttcactagccggtaggtgaagctctttcaagtgggtgagggtagatggtggaggaaagataagttttgttcaattaaaaaacatgtatagacagtctgcagtgtcagacactgtgctaagctcctcattacttcaggagcttgataaaaatactgatttcaaggcccagctcccagagattctgactgagtctttttctaaggtggggtccaggaatcctcatctttgaacattggtcttcaccctttccacaaggaatcacagtggagactttcattggatggcaccttgtgaaaacctgccctagtgttttggagataaggggggggatgttcatggggtagaggggagtgtcactctggagcactctcctgccttgtgtggccacagcacagtcccacagtgaggggccacgtggcactgcgcaccgatcttgagctatagtcacaaagctcctaggcaccacccacgaaaggccgggtgatggcagaacaaaaccatctggaaacctgaagatggctatcttctcttttgcagagaacaaagaagattacgtgttttgttcctaccttgatttcattttcagttcttttggacactgccttagttcagctcaagtgcatttgtgatttcacatgtaaaaaaaattacaaatgagcatcatattattcttgcttagtgttcacaatgctttggcgtccaggctatgttccccttcctttgcattaaaaaatgtgtaattttcatatgttagagctagaagggcaccaaagaagccatgaagatgagctttctgttaatctgttggtggcttgcatcatcattggatgatgcctactgaagcaaacgcaaaattctattataaagctaattcttaaacaatgtgcattacattcagctgctgtggccaccttagctgaggaagacatttctaagggatgtatggtccctgagggctctgtttaggcatcatatcatcaggaagtttatccttattcattcctactccttcctctctcccctcaactctgggatctatgttgttcaatgttgtactatcaaagaccgtattttattggcatttttttttccttttctttctctcctgctgtgagctccttgagggaaatttatgtttcccaggtctttgcatttctaaggctacaatcagaaagtgacacaaagtctacattaaaaaactttaatgaattataattatgaattataaccaaattaacaacactgaacctattattaatgatttaagatatgtagaatgttattgatatctttattcattgtgttccttttattgttgttttagggaatataaatatgtaagcgcttacttgtggtgttttatgactttgagcccccaaattttatattcattatcagatcctgaatgttcaactgccacaacttccatcacaggccaactcaggctgtcctagcaggctgctggatgccagtcacattaggctcaattcaggatgcagtatgtgctggagctggcacacacctgctcaaaggagctgatccttaaattttcaggaattatgtgagaagctgttaaacaatggatagcttgaaattggcaatggcaggagtatctataccaaagcaactggcaaatactacaaatcatatcactgcttctaatgagttacaaaggtgtgtgcttacatgctacccaaaaggaacttgaaggccttcatgtgaaaagatcatatgaataaacacaaagaaattagggaataatggccgggcaccgtggctcacgcctgtaatcccagcactttggaaggctgaggcgggcagatcacctgaggtcgggagttcaaggttagcctggccaacatggtgaaaccccatctctacaaaaaatacaaaaattagccgggtgtggtggcaggtgcctgtaatcccagcctacttgggaggctgagacaggagaatcacttgaacccgggaggtggaggttgcggtaagttgagatcatgccactgcactccagcctgggtaacagagcaagactccatctcaaaaacaaaaaaaaaaaaaaaaagaggaaattagggaataacaaactaaaccataatcaagccctaaatttaatataatcaagaaccaaaagttataacacaggtaagtgatacaggtatcagaaatgggagatgtcacagtcaaccaaaattgtggggggatcttcagtgaggagttggaaaggatgcaggaaagagaggagaggaatatcttcaggatcaggaaccagctgaacacagctgaacacatggagccaagcacctcacatgtgtataggggagagtaaagagggcaacacgaatgccacacagcatgcagccctcagggggagtccactgcacacacgcctggcttctgtggaacttggttactggaagtaccacatctgttgtcttggtccagctgtagcagagccatggatacttaagagtttgagaattaaggtgattgcgtagccggtgcctcctctatttcacctgtcttgcttattgtctatatcctctgtttaatcctcatctcgaccctttccatttatgattagaagttctcttcaaaaatatttctttaaaagctttgagggctatttccattttttgctatcttcatttttgttaacagctttccatggttttcctcataatatatgctttttttaaaaaatataacaaatccccataatccagattaaagctaaacaaacgcaccaggcattaagcaaatcacaaactccaggcttttttctgtaatacatgatacaaaacaatcagtaacactcaattccaggaccaacgagaagggagacattataaaaaatttaaaatgtctcaaaattctgtcactacagattggccttttctgaacatttcatataaatggaaccacacaatatgtgtctggtttcttttacttggcagattttttttttaggttcatctatgttgtagcatgcgtcagtagattgttcccttcctcattcacacccatcttcctcccttccttcctctctccctcccttcttctctctttccttcctttcttcctcccttccttcctctctccctcccttctctttccttcttttcttcctcccactctcctttcctccccatctttccttccttctttccttccttccttccttccttctattcttcctctatttctttcccagatagcattccattgtactaatgtactacattttgtttatccatttaccagttgtgacacaagttagggttgtttccactttagaaataactgtgaatcatgcttcagccaacattaatgtgctattctttggatagaaatatgtttttatttcctttgggtaaatagtggatatttgaaagtggaatcattggatcaaatggtcaacttaggttgacatttttaagaaactgccaaaccattctccaaaatggctgcaccaccttatattcccatcagcaagtgtgagggggtcttattcacatcctggccaacattccttgttgtctgtcttttttattataaccattgttctgagtgtttagtggtatctcactgttttgatttgcatttccctaacaacgactgatgttcatcgtcttttcatgcatttatgccatgctttctaataaagcattcatttcaaaatacattcatttgactattcgcaactgatcttttcttgtcactataaatccccaacttagaaaaaaactcttctgatcttaagagtattgtcttggtgtttataaccatcacctaggtgtcagcctgcatggattcttttagagaatggcacccaataattgtcctgtttctgtgtgctacccctttatgtgaacagccctgcagaggaagagcctgctggatgttcctgatggccctccagacctgctcttctctcttgtctcccctcatctgtgctctggaggctgactttgtaccaggatcccttgtgtctggcttcggatggagacacaggcaggtagagagcaacattgaagagcatttttcctctgctccctcactgtgggctgcagtttggaagtagccactgcctttccctgcctagtttttaattctggccaagcagaccctttccaggggctgaatacacttgaaagctcctaccaggagctccctcctctcataccttcagggttagagatggtaagggctgttttgggtgactggtcccttattcttctccacccactgatgggtcccttaaccttgtcaacccttctggagagagcttctttttaactatttatttatttaaatagaatagagatagcatctcactttgttgcccaggctgatctcgaactcctggactcaagtgatgcttccgccttggcctgctgagtagctaggactacgggcaagtgccaccatgcttggctaatttttaaattttttgtggagacagggtcttcctacttcctatgtgacctaggctggtcttgaactcttgggctcaagcaatcctcctgccttggcctctcaaaatgctgagaatacaggtatgagccactatgcccaatctggacagagcatctttaactctcatttttcaagtgtgtcttctcctttttgctgggactctgatacaggagataagcaaaactcctttgtgaaacctaagaccagcacttttatgcataaaacaaatggttagtgctaatgattaacttaaagtagtttcttcagacatatttgacacaacattacccactagtgcctgttcacctctgatcttgtagcactttgggcttttcacaaggacttgtcaccctctaccttgctttgtactcacttgcagtaggagacaattcccaccaccttcaccccaaacagcataaaaatgtaaaagttttttccagtttccctaaagtcatctgagcagctctccctaacccagaggagtgcaattactctaagaacctgtccatacaggcgttttttagtagatgttctttactcagattggagttatgaattgctaaccgtctaaattctctactgattgggagaatgagatgaggagtgaggggaagaaaggaataaagactcatctgaagcttcctaagagggccagcccaggagaaaacagccatgaggcagttcaaatctgcctagccaagccagggacaaggagctgggaatccccacgtgctgtaactgtcacaaatgccacactcaaatgcagatccctgggccactacagattcactgtattaatccattctcacactgctatgaagaaaccctgagactgggtaacttataaaggaaagaggtttaattgattcatggttctgcattgcttgggaggcctcaggaaacttacagtcatggtggaagacaaaggagaagaaggcatcttcctcatagggtggcaggacggagtgagtgtcaagcaaaggcggaaaagtcccttacagaccatcaaatctcttgagaactcagtatcacaagaacagcatgggggtaaccacccctatgattcaattacctcccatagggtccctcacaccacgtgggaattatgggaactacaattcaagatgagatttgggtggggatacagacaaaccatatcattatgcccctggcccctggaaaatctcatgtacccacatttcaaaaccaatcatgccttcagcattaactcagaagtccacagtccaaagtctcatctgagataaggcaggtctcttccacctatgagcctgtaaaatcaaaagcaggttagttacttcctagacaccgtgatggtacacgcattgagtaaagacagctgttccaagtgggagaaattggccaaaacaaaggggctgcaggccccatgctagtccaaaatccagcagggcagtcaaatcttaaagctccaaaatgatctcctttgactccatgtctcacatctaggtcatgctgatgcaagacgtgggtccccatggtcttgggcagctccacccctgtggctctgcagggtacaacctccctcctggctgctttcgtgggctggcactgagtgcctacaggttttccaggtgcacagtgcaagctgtcagtggatctaccattctgaggtctgaaggatggtggccttctcaaagctccactaggcaaggccccagtagggactctgtgtgggggctctgaacctacgtttcccttttgcgctaccctagcagggcttctccatgaaagccctgcccctgtagcagacttctgcctggacatccaggcatttccatacatcttctgaaatccacgcagagtttcccaaacctcaattcttgacttctgtgcactctcaggctgaacaccatgtggaagctgccaaaggttgaggctttaaccctgtaaagcaatggactgagctctacgttgacccctttcagccatggctggagtggctgggatgaaggacaagtccctaggctgcagacagcatgggaatcctgggcctggccaatgaaaccacttttcctcctaggcctccaggcctgtgatgggaagggctgccgtgaagacctcagacatgccctggaggcattttacccattgtcttggtaattaacattcagctcctccttacatatgcaaatttatgcagccagcttgattttctcctcagaaaacgggattttcttttctatcatgttgtcaagctgcgaattttccaaacttttatgctctacttccatcataaaacccaatgcttttaacagcacctgagtcatctcttgaatggtttgctacttagaaatttcttccgccagataccctaaatcatctctctcaagttcaaagttccacaaatatctcaggcaggagcaaaatgctgccagtctctttgctaaaacataacaagggtcatctttgctccagttcccaacaagttcctcatctccatctgagaccacctcagcctggatcttattgttcctatcactatcagcgtttttgtcagagccattcaacaagtctctagggagttccaaattttctcacattttactgtcttcttctgagccctccaaactattccaacctctgcctgttacccagttccaaagtcatttccacatgtttgggtatcttttcagcaataccccactctactggtcaatttactgtattagtccattttcatgctgccgataatgacatacctgagacttgccaatttacaaaagaaagaggtttaattggacttgcagttccatgtggctagggaagcctcacaatcatggcagaaggcaaggaggagcaagtcatgtcttacatggatggtggcaggcaaaaagagagcttgtggaggggaactcctctttttaaaaccatcagatctcatgagactcatccactatcacaagaacagcatgggaaagacctgcccccatgattcaatcacttcccaccaggtccctctcacaacatgtgggaattcaagatgagatctgggtgaagacacagccaaaccatatctgcaagcaaggagggatgtacctttagtagaattaaaccacttatttatgtgaaatactaccactgctatggtctgaatgtttgtgtcccccctagaaattcatatgttgaaatgaaatcaccactgtatttagaggtgggggcttcaagagttgattagatcatgagggcaaagcctcatgaatgagattagtgcccttataaaggaggcctgagggagattgcttgtcctttctgccatgtgaaaatacagcgagaaggaaccatctgtgaaccagagaatgaaacctcactggtgactaaatctgccagtgccttgatcttagtacttgccagcctccagaactctgagaaatacatttctattgtgtataagccactcagcccatgatattttcttatagccgcctgagtggactaaggcagtaatgtaaagattttactagcttttatagtaaaaatctagcttttctagtttgttcttcatatatatatatatatgagcattttcaaacagagtacttctggaagctgaacaacagtgtctcctgttaaaaaattcaaatcctcatccaaattgacatacatgtgctggcgcatatgttgtttatttctctgctgtttataccaaacttttcctgcaaacgcatccatcacacacacatgtggatacgcacaggcacacacatccaaatacactgcaggtaagacccactactactagtctcacagtttcacagtgatgttgggccaaaaacctgatccattattacttactgcggttcacggaagcagctttgtaaacctacataaagattcccccttccttgggaagccataaatgcaacgtttcactgagcagcatggaggcagggtgttaacctgctgtgtgactgctttcaaagagccagcactcctcagcagaagcctaatcatctctgtggatgtgctgtcctgggcctgcttcgataagtgctgtttatgtggctgtattttcaagatagcatggagggatgctaaacttggtatttgaaatctgtttttcctcacggcagcaacaagcctgcagcacagcgctaccagccagctagccaaccccacagccgcctgttgggcaaaggaaccctggaactcgttgaggttgcaggaacatacagaagatcatttctcctctttcattttcttgctgccttttctttcttaaaatcttaacgtcccaaaggaacaactgatgtgagtcagtatgtgttggcagggcaggatggtgtgtgtgtgtgtgtgtgtgtgtgtgtgtgtgtgtgttcgtgttcattcttcctgttcctgttttcccacctcagccttgggtgtcgatgaaactttttttttttttgagatggagtctcgcactgtcgcccaggctggaatgcagtggcacgatctcggctcacttccacttccgcctcctcagttcaagcgattctcctgcctcagcctcccgagtggctgggattacaggtgcctgccaccatgcccagctaattttttgtatttttagtagagacggggtttcaccatgttggccaggctggtctcgacctcctgcccctgtgattctcccgcttcagccacccaaagtgctgagattacagaaatgttttatatacctatttgctccaggcagagtttgaaggcagagacttatatcaattagagatccataaaagccagtgaggtgacatgaacaaaagcattcccaccaacactggaagtattcaagccagattttaaacatgagatttccactttaggataaaggttggatccgataactttgaagatcctctgccatttaaaaattctatgggccagacgtgatggttcacgtctgtaatcccagcactttgggagacagaggcaggaagatcacctgaggtcaggatttcaaagccagtttggccaaggttgtggcacatgcctgcaatcccagctactttgaggctgaggcacaagaatcacttgaacctgggaggtggaggttgcagtgagccgagatcatgctcctgcattctagcctgggcgacagagtgagactctgtccaaaataaacaaacaaataaataaattaaataataaatacaaaaataaatattctgtgatgccatgatcttactcccagtttaatgaacagttctgatggtgatgtttagagtgaaactcatagtttccttgaatattttcctactttgcatatttcccaagatgctttttccattttgaggaagatacaagataagatacttctcactgaaagttctcctttaaggggagaagcaatggcatctgaatctcaaagtttggaaaaaataaaccgttttttatctcttggctgaaggcaaagtgaagaagtaaccacagctcagctctgtggagagtgggggtggcagatgggaaggtgaaggaaggaaaagcaaacacagtcagccctccctccacactggcatccatgcatccacggattcaactaaccaaggaccaaaatatcccaaaaataagaagaaaaattaaaatgacagtacaatgaaaaaaaaatacaatctaataagacaatagagcacaacaactatttcaataacatttacattgtatgaggtattataagtaatctagagatgatttaaagtatatgggagtatgtgcccatatacacaatggcaaatcctatgccgttttatataagagacttgagcatctccagattttggtatctgaggggaatcctggaaccaattccctgcagatactgagaaacaacgctatgctctgggcagaagtacttccagaagagccacacgattgttcccctatccttgctcaacaaaatgccagcatcagaagaaacaatggaaaaacctgattctttcacaagagctgacctctgactataaaggatttagggacaagattcccaacctactctatatggcaaaggaagaaaataaaatgttatcttctttctccccagaggtcactcattgcttttcctctccaaaatatgcttgtcttagttcattcagcggctataacaaaataccatagactgagtgtcttatacacaacaggaatgtattgctcacagttctggaggctgggaagtccaagatcaaggtgacagtggatttagtgtctgctgaggacccactttctgattcatagatgatgctttcttgctgtgtgggcactaatctcattcataaaggctctaccttcagggcctaatcacctccccaagccccagcctcctaataccatcgtattgggggtgaggatttcaacatgtgaattttggggacgtagaaacactcggcttatagcagtgctctttttattttgccttactgatagctaaggtcactctgtgtgcacatttatttcacacttgaagcatccctggtgtttttaataatcacctccagcctgtcacgtgaaattaataacacacacacacgactccatttttcatcaaggccaccttccagaaagaaattactctttgactactcagagaaaggtgcagagattattataaaaatcaggagaggcaatgaataatatgaagaaattcagtgtcccaagttcttttcctcccacacttatttgtagccagtgtgatcattccttatgcacctaaactgcataatctaaattaattccaatgtgttgtagagtttcaccaccattacagtttgctgtgattagcaaaccttaacctagtgccttcatgtagaagtatgactattttcacagttttgtatgaatgtacttgctatatgaccttgggtaactcactttaccttctttgtcttggtcttttaccatctgtaaaatatagtatagtttttccttctccatattttatgattaagaaaaaatagaagatggttagaaaataataggaacacatgattcatgcaatcatgccaaaagtaccaggaaatcacatttcaacatataatttctatgcaggttatcagtaaagcacatctttaaatcactttcaatcaattcacaaggtaacagaattttgatttttttcccctttttaggtgcggattaaatatcccatctagattaagttttatatatatatatatatatatatatatatatatatatatgtaagaatcaatgcaatatcatataggtctcaaaatacgttattttcttactccttctttacattcttctcattaagtcatttttttcacttaacaaatattaattgagtggctactatattccaagaagtatgttaggcatcacaggctctcattttatctatatgcctggtgacaggatagctttgccttgactatatggtgttttcaaattttctttcttttctttttcttttttttttttttttttgagacggagtctcaccctgttgcccaggctggagtatagtgtgctatcttggctcattgcagtatctgcctcccggatacaagtcattctcctgcctcagcctcccaagtagctgagattacaggtgtgtgctacaatgcccagctaatttttataattttagaaaagacaaaattttgtcatgttggccaggccagtcttgaactactgacctcaagtgatccacccacctcggccttccaaagtgctgggattacaggcatgagccaccatgactggcctcagattttctattgacttcatttctatatagccagacagtaatgaattggttctgctgaaaactgtggtcaggataagttagaaacccttttgtttccttatgtatgtctttctaaatttctgctgagctacatcttaataccttattcccagacctcagctcagtgccccagtgcctgacacaaaataggctcaaataataattagttgaaatataaataatgatcataatgctaaatgacaaacagcccttctactactgggtgacctcgggcaagtcactgcatctgatgctctcttcattcataaaataatagacaaggctggtggttgctaaccagctgggtcaagactggtgttattgtaaagatgtgaaaatgcatatacattctataataagtcctacataaaaacagaatatactatttgtcatatatatatgtatgtgcgtatgcacaccacacataaaacaaataacagttttacatgcatgtagattactgtgtctaagaaaaccagtatcatttaaaagcactgtagagtttataacatcttttggctactatgtatttcgttaatgagcacatacaaaaatgtaaaattacaaccattttgacattctaaaacaccttcacactccaacagggcatcactggattaaatgatcttcaatgtcctatctagcacaaatatctgtggttccaattcaacagaaagcagaaaatatttctcaagtgttagctatatacacagcaaacaaccaagtggaaagcagaaaatacagccaatgaactctacaagtagaaaatgtgagcattttctctttttttttgagatgaagtcttgctcttgttgcccaggctggagtgcagtggcgcaatctcggctcactgcaacctccacctctcaggttcaggtgattctcctgccccagtatcccgaatagttgagattacaggcatgtgccaccacgcccagataatgtttttgcatttttgtattttttgtagagacgggctggtctcaaactcctgagctcaggtgatctacccaccttgacctcccaaagtgctgggattacaggcatgagccactgcacccagcctcattttcttttttactaaagctgctgccatgactggctttatcatgccactccccctcccctgtccccaaggtacactggcatggtcctgctctccagagtaagttctacacataaatgacccttttccctttgtccagtaaatggctgggccatgtcctttaaaccagcagtagctgttaactcttggttaaccacaccccatacccacaatgtcaagcaataaatgtttttgggagataactaaagaggctgctggaaacatttgctgcatgttcaatagtgactgacagtggagaggagggagtggtgggcatttcttttatttttatattttgagatggaatcttgctctgtcgcccaggctggagtgtagtggtgggatctcagctcactgcaacctccacctccagggttcacatgattctcctgcctcagcctcccgagtagctgggattacgggtgtgtgccaccatgcccggctaattttttgtattagtagagacagggtttcaccatgttggctaggctggtcttgaactcctgacctcaagtgaactgcctgcctcggcttcccaagataggcatttcataagaatcatacaacctgtcctccctgtacctggggcatacacagaccaagggtacaatgcgtatgagctaaagagatcctggctgcaacgtatttgagcaaaaaaataataatcatttgtattatacaatgaagagagatgatgaaatggttgtgacttatttgagaatataaactatagtgatcaataaaatcacatttggtgcggtatttaacccatttatagagatgtatattttcactctatgttaatttgcagggacatttgagaggaaatgtctgtataataaaaacattaaaatagaaatatttcaatctcagttttgcctaaggccccaagtccttgtttatcaggatttgaaaacaagataaccagaaaaaaaaactttatgactctgagtccctcagtcatcttgaggatataaatctgatatgtatattaagggttcaaaatggtaggattagaaattaaaataaggcttatttggataaattgttctataaaccccctcccatagggagtgtgggggagtttgcctctcacctcaatccaagagaaaggttttagacatcttgatatgtagcccctggggtttggaaactgtattagtcagtgttctccaaagagactgaatcaatagaatacagatatagatgtagatacagatagatgtgagggaatttattaggggaatggagtcacacaattatggaggctgagacatcccacataggccttctgcaaactggagaaccagagaagccaggagagtggctcagtccaagtccgaaggcctgagaatcaaggaagttaatggtgtagctctgtctgaggccaaaggcacaagaacccagagggccactgttgcaagccctggagtccaaaggcgggaaaacctggaatccggatgtccaaggccaggagaagaagggcatcccagctccaaaagagaaggtgagcaagagtctgccccctccttccaccattctttttctatctgggcccctagctgtttgcacggtgtctgtcaacatcagggtggatcttccccactcagtccactggcgcacatgctagtctcctgcatacacaccctaacagtcgtgcccagaaacaatgtttcaccagccatctaggcatccctcaatctagtcaagttgacacctaaaattagctatcacgcagactgatgtctgatttgtgctataacatctatggaaagagagacggtagcggatacgcagttctgattgtggcctgaagagagggcaacaacctgtccccacagagagtcagagcaaagaaagcccaagttccttagactctgctcaggaagcctgtccagccatgcaagaagactccagcagaaggaaaatgaaggggtgccacctgcatgcagcgggtgaagggctgaagaagggatcctaaacaaccaggagaggagaaacactcaactctgtcaaagacactgcagataggagatgtcaagtgaactgacaggatggattaggaactcttttttttttttttttttttttactttaagttctgggttacatgtgcagaacgtgcagttttgttacataggtatacacatgccatgggtttgctgcacccatcaacccatcacctgcaacaccaggctgccacaacacttgggttacacctaatgaggtgactccatttccattgtattgctattctggttagtgagaagacacactataggataaagtttgcattagaagagccaggaaaatatgaagtagaattcctctttaattaatgttaaagaacttaatcacagagggagaaataaatgttcacattggcacccatcgatatcatgaatggaatacaagctccatggtaccatgtgcttcctctcttgtaggatatggactgagccaccttggcaaactatgcccatggtatattcacttcatcaacaaagctagtccagaacattctatgcatttgcttcttataacctgattcttggccacttaagcagcattctcaatgcttccaatgagtgaaaatgaaaaaaagaggacaaaataagccaataattccagctcattagcagccaaaaaaaaaaaaaaagatctttgggcaagccaaagttctaaggggaaagggggaataacgacctaaagaccagtgccacgtatgtttgatactcttaactgtaactctggaacaacaacaacaaaaaccccatccaggtttaaaaatatgtgtaaaacaccatattataatataatctcatgtttattattttaaagtaggaaaatgcagatagtgtgtcttttgcatcactgttgaaaatacgatcattcattgaagacagagcagtggtatcctagttaaaactctttcaagttattcaacaataattgggagcttcatcaatagcaattgctattttccatcactgaatgcaactcattcctgaagcccattgaacactccagaatattgtgcaggcgtaggtcttgctgactcagttgtagccagcaatatttagtcatgctcctcgtcaggtacttctggctctctatgatgtggagaaatggtaggaggatgtcatttggacccctgtgttcaatggagcaatgtggttggttctggccaatgagctgtgagtggaagagacctgccgcttctgccgagcatttcgtatatgtgtgggtgtgagtatactctccttctcctcccatggtggccagcaacgttccaggggctgagccccctgagaagcaatgcccccatttgccagagtcagccatgtagtatgagtgaggaagaaaactttgtcttaagcccatgagattcaggggttatttgttactacctgttaacctcccctgactgatacaaaggtcttattgtctacctccttactgatattgactgatcaggtcacttactgaatatgcctggactgcaactcagtgcccatttttattttaaagatcgatgagttgttttatgattggaacttggggtaatacaaataatacatttcccatacgagcatcactaagagtaaacattgactgacaatgaatagtcattgttgatttgcacataaacccacaggtagattttgttcattttgtaagatagaaattagatgcatttgtcaggctgatgactgagggtgggagcatcatggagagtcacattagaagtggtgacacctgccatgagggcacagcatttgtgcaggtactgtgagaccaaatgcactgccttcaagctggatgcaatgtaatcaatccactttaacatgagtaatcattgctgagcatttaacatgagaatcatattataacacatattatgaggcgctgaacaatttggtgaagaagagagttatacaagttatatcgatgagttcagatgatttgaaaaaaaaaaagtggttagatttacaaaaggcaaggaaggaaaatgtgtaaagggaaatactctgtgctgctcctccagaaagacattccccaacagaggggggcttgccccagtgcggtaccacctgtgttggggcaggtaagcccacctctttgggtgttcagcattggataacacatttacctgcagatctaaaccacatcccgcagtgtagactttttcagtaataatggtggaaacctgatctccttggccttactactttgttctatgtttcaatttgtccagaatagggacagagaagcaagtgctgttgattggtctcttcaaatacagcaagggaaagtcctaatggagaagccagtcttaggctgagatgggaaggaaggaagaaatggggtttgaacgtgaggaggatgggaagtattccaggatacagtactatggcacaaaatcaaggactaaatgcttatctgtctattttttgagttctgtaaagtgctttcacatacatgataaaaatgtgtaatggcactgatggtcagtgtaaatcctgtgctctcttctgtatccaaacactggcagccctggactcctagtgaaggagacagacatgtgtcctgtttttgtggcgagattctagtggtgaagttagacaggaagcaagtagtacgtatataaagtattttcagatactgattagtgccatgaatgaaaataagggagggtaaggagacaggatagtggaggctcgctcttctgggcagttggttaggtctggtctgtgaagatgggtctttgatcagagtcctaactgcaaggagacaaagagccccaaggagaaacaggaagggaagaatctcaggcagcaagaaaggcaatagtacagaccctgaggggaaacgtgtttggctgtggaggaggccagtgtggccctaggggatcaggaggggtgagtccaggggaagaaagccataacatgcaagtagcagctggaggaggaccccaatgtccaaggtcaggggccctgaaatgaaagaaaaggccagtgaaagccaggactgtgcccagagaaggcgaagtgattagaacactcttgaaaatgaatctgctactgggttagggtgtctccccgaatgtcgggaaaactggccagaggtcattaaaatattgcaggtgcgagataattagaacctagccttgggcagttattacaggtgctaaaatctgaaaactcaaactgaggaaaattggcagagctgggagacttattggatgacaagggcaaagaggagagagaaatggcagacaattcagggtcactggctgactttcactgtcagtgatggcagacgtgggaggggaggccatctaacaaatgctcacgtctagggcttatgtagtcaacggtgagagcaacctgcaaaaaaataaaaaataaaaatactgttccaagagccattttttaaaaaaagaatgtcacgcagactgaaaaagaaaatcaaaataaaatcaagaaaagggattgtattacaaactcactattctcaagataaactgaaaaaggcaaatttcatacttagtaatgagaacaaaataaacactttcaattgattaatattgcaatacaatcattttgattatgtgtctttattttatttgttattttttcagtcagggtctcactgtcttgcctatgctggagtgcagtggcaacctctgcctcccagtccaagcaattctcccacctcagcttcccaagtagctgggattacaggtgcataccccgaggcccagctaatttttgtattttttggtagatatgggtttcaccatgttggccaggctggtgaactcctgacctcaagtgatctcccctcctctgcctcccaaagtgttgggattacaggcgtgagccacctcacctggccagattatgtgtctttaaaaaataaaaatgaagacatgcataaattagtatagtagaaggaaaaaagagatacgacaccttttatcttttttagggatcaatgaaaggccaagagatttgagaactgtaagaaagccctgagaagcacattgttcaaaatttatgctcacttgaaaaaaagaaaaaaaaaaaaaaaaaggaaatgacctaggctgttacaaaagttaaacccaaattgagcaccttttaaataaggttgtcaaaggttaagtatgtttgaggtaaaattatttccccagtctcaaaatgaaatttccagtagactttagaaaaaaaaaatatggaaaacaaacatacatggagaaactgcattttacaactgaacactgggtttcaagtagagtgatttttaaaaatctcatatttagatactgtctggttttaaaaataggccaaatggatcataggctgagaatcagaaatccttcttttgggttgtctcttctccgtaagcctcaagtacttcttagtcctttcttcatgactagataaaattatagtaactaccacagggattatgattcctagtcaaacatcaatcatagtcctacacacaaatgatgtcaagtgctaggcactgtctaggttctataatattagagttcctaaatttacacacgcacgcacacacacacacacacacacacctgagatagaggatagaaagataaatgatgatagatagatagatagatagatagatagatagatagatacatatacatagacagacagacagaaagatagatgctaggctgggagtggtggctcacacttgtaatttcagtcctttaggagcctgaagctggaggattgcttgagcccaggagttcaggagttcaagaccacctgggcaacaaagcaaggctctgtctctatgaaacacaaacaaacaaaaaattagctggacatggtaacgcacacttgtgctcccagatactaggaaggctgaggcaagaggatcacaggagcccaggaggtcaaggctgcagtgagccatgattgtgccactgcactccagcctgggcaacagagagagactctgtctcaaaaaaaagaaaaaaaagaaagatagatgctagatagatgatagatggaaaggggaaggaaagggaaaggggagaggaggggaggggagacgaggggaggggaggggaggggaaatcccttcaccgaagacttgtaggtcaggtctcaaagagcagccagcagacagccttcagctgtcaactacatcagggattgacccagctgcagagaactgcctcacacaaggtcacaccccttcctgggtgactcacaatcaactgacacaatcaataaaacctgtctgtcttgagccaagttggcacaactctgaagatccattctgattgtggagttccctgtgaggtctgtgtggctgggcctgcattgtagctcaatttctccccctcctcactactgtctcctctcttcccttccagatgtcattaccaaggatcctttttaattagcatcctatattccaaactctaaccacagtctgcttcctgtacttgcatatattcattacatacatatgtgtgagtgtacatatatgttttaaaaatccctagcaagagtaagtacgttatttggtcagtcagctgttaaaacttccactttctccagttgtctggtggaattaaaaaaaaaaaaagactttcacttttattagtgcaattcatatcagtgtgccactggtagctcttggaagagaaggaagagagagctaatatggaacctggagacaagttccactctgctcctgctgaatgcccttctcctttgcttctacctacctccagaagtgctggccattgtcagctcctgaaaaggctgatgctctgacctgtttcagtgaacggggagaggacttgaggctgggaaacctttggaataggcaaggggtccccctacataggcttccctccatgactcatagtgtgttccttggttcgctccctgtggtcaaccacctgctgcaaaaagtcgttcactgctggtgtgagaatcattgtcacctacactcaagtaaaaatgtgtatcaaaggaacagatgcttctcttccatgcaacctgaatatagatctatcaggcaaattcagacagctgttctagatgcagagaccatcatatctgctaggggtcagcaaacactgaccatggctcaaatctggcctgccatcagattttgttgggcccgggagtgaagaatgttttcaggcttttcagtggttgaaaaaaataaaataaaaagcataatatttcataatatgtgaaaattatataaaatctaatttgtagtgtccataaataaacttttttcttttcttttcttttctttttttttttttttgatactgagtctcgctctgttgcccaggctggagtgcagtggtgcgatctgggctcactgcaagctccacctcccggtcacgccattctcctgcctcagcctcccgagtaggtgtgactacaggcgcccgccaccacgcctggctaatttttttttttaatttttagtagagacagggtttcaccgtgttagccaggatggtctcatctcctgaccttatgatccgcccgcctcagtctcccaaagtgctggaattacaggtgtgagccaccacgcctgtccccataaataaacttttattaggacacagccatgctaattcatttacatattgtctatagctgcttttgatccacaatagcatagttgggaagttgtgacagatacctgaaagccaaatatgtttactatctggccctttgcagaaaaactttgccaaccacagagctatgcgatttaggattatacaacacaatatcacacatttgcttattggtgaacatccaatgggtggatattcacacagatatagacttgttacctgtacatgtctgtaagtatctggcctctcataaaacactaaacaccttccacagaagtgcacaatgatgtagagaccccacgttatgctcaaacccaagcgctatctttcttcacatctttttagttcaaaatatctgccttaaaacagaactggaaaaacaacatttgtcaagtaagtgcagccgtgttaatgttaaatagatgaatgcatggatggatcttttaacatacaagcaatggagaagatatgccagcaatgataatacttgtgttagtgtgaagggtattttagatctgccccaaactcaggtagaaaaagtttccctgaccttttccctaccagtttagaattttaattcatcccagagagtcagtggctttgacacaatagcacttactcttcagatgcctaaaattttatggtcaaaaatatcaaaagattagaaatgtgattttcaatcccaaaagccacattgaagttcaattaaacaaaaatgcctggggttttcatatgcactgaaaatcataaaaatcaattttattacaaatctacccatgaaaccgtctatctgtctctccatccatcaatttatttctgcaatatgtctcaaaatagcacccaagagtttgtgccaattcttatttttcaagatatatgagctttttcaagttcacaagctccataaacttcacaaactccatatggtgttcacaaaggaataataaatgttttttatcttttacattgtttatgaacacataattcatttttactatatcaattgcttgcctaagaagttacaatgcttccttttctgcttattctggcttacaagcctttcagaattgaatcttacctgatctgttcaatattacattctacattacacacccaatttcactgtatctcacccacctgtcttcctacacactaaagcccttactcctcctaatcgccatgttttcattatctccatgtcccttttatgtgttgttctttctacaaagaaaccccttttctcctctttttgaaaaacacctacttatccttctagaacaacctaaatgtaggaactttccaaattctccagggaaatatagcccttccttccttccatccatccatccacccacccactcacctactcactaatttatcccttactgaacaaacatactgagcatctattagatgctcaaaaatgtataacaaataagctatttctgcttggtttataaggacactgagatatcagcaaagtgttatgggaccgaagaagaagaaaatagaagaaagacatcaaagtcaaactggaagtaggacagtttggaaagcatttcccagaagaggtgatactgagttaagtatacacaggacaagaattatgcagccaggtggatgagggatgggaagaggagaaagggagagggtgttctaagccaaaaacacagcaggtaagaaactgagtcaccactaggaaagttaaatcaatatggcagaaagaaaacctgctccttgggtcatttcatcatgcgtttggtagagcacttacaactttatattaagtaatatgggcttgaggttctgctttagataatatggacttgaggttcttctaccttttattacctgtcagaaatagggttttaatccctgggaggtgaagcttgcagtgagccaagatagcaccacggcactatagcctgggtgacagagcgagactccatctcaaaaaaaaaaaaaaaaaaaagaaaaagaaaaagaaaaagaaatagggttttcatctggaaatatttggggctaagtgttgtcctgaaaggaactttggaaaagaaatattccattacacttgctttgtcatcttgtgatacagactcagcccatggatcaacaaaatgccttcattctcaacagtccaaagagctctgggtaggatctcaccttccttacaaaattcatgtcagatgttgaataatagacattattctgttcctcttccaagtgagagacaatgagtggctcatcccctgaacggtgtgtggaataaggtgaaacatgtagcaatcaagaaactggactcatcccctgaacggtgtgtggaataaggtgaaacacgtagcaatcaagaactggactcatcccctgaacggtgtgtggaataaggtgaaacacgtagcagtctagaactggctgcagaatatatgtttggattttgtaactttcatgctcccaaaactcagagtcatttttctacattggctctttccctgtattatcaattgtacccttcacataacaactgtttcctaatggcaaccaatcaattcagaattcaaatggcgattcgccagtttgatatctacgttgccctggggttatggaagaagctgcaaattttggggtactgttccagcttattaaatctttttattgaaatttgattcatcttttcctgaccttatcaaaccatcccggccttgtcatctacagcaggactttgcaaagtggactcctgtcgcttgctgcattttactggtgtgaaatcagaaggagtatggtggataatgcattttgaatccggttagacattaattattaggttggggcaaaagtgatagttttttttgccattaaaaaaccatgatcacttttgccccaacctaataacacccaaaccacctgtagaaatgatttaagaaatcttcaactcaaatgccttctttcaggaggagttttaaaatagaaattacatcattccaaggttgtgtctgcatatgcagttgtatcaaaaaacttaaatgtaatttttgagggaactaagccaggagaaagggccatagtgatgaatgtatccaaaagtagccatcagagaatccgtgagttcttacactgacacaggaagaccactgtgtttgacagatgcaaaatttccattcagatctggtcagcactcttcacctaactggtgtttttaagagataattaaaactgtttgcacaatggcacagtccatgacacattaataataataactaataacacattaataataataactaataataactaatggcacagtccatgacacattaataataactaatatataataattatattattataactaataactaataataactaatataacgaattatattaatgatagtaactaataatgtgaccatgacacattaataataactaatattaataataataactaatattcaatttaattctcatttctataagtgccaggaaatttgctaacattgtatgtatacatgtaatacatgtacattacatctcatgtaatcataactgttttattgcttttttttttttttttgagacagagtctcactctgttgctcaggctggagtgcaatggcaccacctcggctcactgcaacctccacctcccaggttcaagcgattctcctgcctcagccacccgagtagctgggattacaggcgcctgctaccacgcctggctaatttttgtatttttagtagagatgagtttcatcaccttggtcaggctggtctcgaactcctgacctcaggtgatccacctgcctcggcctcccaaagtgctgggattacaggcttgagccaccgtgcccggccaactgttctattgttaaagcaggtagctaggcagacgtgagcaggtcaggagaggacccccaacccctccccaggaatgtcagctgaccactaggtaatggtcaggaggttgttaaactatttctctaaaataataattgattgcagctggtaccaaagaaagaccgtctcccaatagatataaaacacctgaaactggtgatcagcttccaaataagatctcagaagttgggcgagcacgctaagcatgtgcactaagaggcaaaatggcggcgtttaactggtatatgagcttcctccaggaacgctctgctggtaagggaaaaacgcctcaagtgagcatgcacacaacttcagtaaacacactgcgcacgcagccccttccaagtgctgacaggccactgtacatgcggacagcccgctccgaaggaagaatcaggggagaagaaatgcaagcccaaaaaccctgccaaggtataaaaccccagtcaaggaccggatggggcactggatctctcaagtcacccacttggtcctctggcaagtgtattttgcttccttttgttcctgccctaaagctttttaaacaactctgactcctgctctaaaacttgcctgtatctctcccgctgccttaaacccacttctaccccttggccaaattctttcctttgaagaggcaaggatcgagtttctgcagacccatacaggttctccactggtcacaccatcaagtaagcattatcattattattcccattttacagaagggaaaactgagtcttaaagttataagctttcttccccgagttcacacagctaataaatacaagaggagaatttgaagtaaggcagtctgactctggttctaaaccaagtttatagtctattgatagctgttgccattgttaaagcccatgtcatatttagaatatagttccagagttggcacattggaaatgacaatattactttaaaaaatgtgttgaagatgggagttaaattgttttggaatttgccactacataaactatataataggggcagatatgagcagtgtcagattaagcagagacaggctccgtggccaggaaggcataaccatttgcggcttaacacagccaaaaggtcagaaagggggttcattcgagggagccaggaaacggggcctgaagcaagacttggcagtgacctcctaactttatcagtgaaaagaaggtgatttcactcagcctgctcagtcctagggctcagtagctttttgtggagatgactgcatagcacccctcttttcaaatacagggtggaggaaatcaaaatatctcaaaacatccttctcggacatattttgagatggatgttcagagggccagcagatagaagtagccatgcaaagctgtcttttgtcggggagatacacatctgcagagaaaatctgcattgatgtagccaggctttctccaagggcctcccctgtcctcttccagatctaggaaagattaaccgactgtcgacacctttgaaggtctgaaagaaacatttaccatctattctctctgagggcggctacctgtgagatttcatctacataacaagtgatctttgctagccagggctcctcttctctccctcccataatcacaacctgttttgccacaatccaagcccccattctttctgcaacctcaagatggtacataagcttctgaaccccactggggagttgggataatcactctgcagttttcccccatgcacatgttatctatgaacagaaggacaagttagttaccctctcctcacaacccacacctcaccaacaagcaagccatcaattttgcagcagactgaagctggaagtcctctaattcagttccactctgacactctcttcctggagatagcgtcagatcccacaggttgagggctcagtccccaagaatgccccttgcttctgacgcgaattacaagtcccagtttatttcacctgtgcttctgacagaccagctggaaattagagatcccatgatcccctgcttgagttcaattaatttgctagagtggctttctgaacctagggaacacttatgcttactggtttattataaaggatattacaaaggatacaggtgaagagatgcatagggtgaggtatggaggaagggttgtggagcttccatgaccttcctgaatggctccaccctccaggaactgccacatgttcagctatccagaagctctcagaaccctatcctcttttttttttttttaagcttcattatgtaagcatgattgactaaacctttggccattggtggtcaacttaaccttcagcccctttcccctccttggaagttgaggggtagggctgaaagtcccagccctccaatcatgcattggtcttttcagcgtccggtccccatcctgaagccacctagggactgccagccatcagccaactcattagcatacaaaaagacatcacttcggagattctaaggattttaggagttgtatgttaggaaatgggatcaaagaccaaatatatattctacaatatcacaggagtccttgaccaaactagataggccaggtctggcagactgttgctagctttacctcatctttcaatttttctagagaagtcagatatctgaacattaatgtgaaattttccatgtttaaaaaatactgcgcaggccaacaaaacacatcccctactcagattctgcgcatgggccaccgatttgcaagtggcatgtgctcatatgtacttcagatcaatacattctaataccgaggcaacttttttctcagtaatctaaatttagggaactattctcagaattgcccataggtcttatataatctgaacatcacaagagaactcaaatgactataaccataatcgtagaactgaactgtgtcattcacatgctgtcatatccatcacatttccaactcattccaagcaaatcctcagctgatcctgtgtaagggctcactccttccctatgtgcgttctcatcatttgatgaacttaactttggcaaggagctagaagacttagctcttgacaccacagcatgagatgggaactaaattggtatatgacttgattcttgggcacagcagtttatgtttttaaccaacactcattccagaagtagactacataagataagtagcatacacacatatgcatttcttaaactaccgatttaataattcattccccaaatacttaatgattgcataccatgttacagaatctatgctaggggtcgagcacacaatatttagacacatgcacacgtatgtttattgcagcactattcacaatagcaaagacttggaaccaacccaaatgtccaacaatgatagactggattaagaaaatgtggcacatatacacatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggcgattgttgtggggtagggggaggggggagggatagcattgggagatatacctaatgctagatgacgagttagtgggtgcagcacatcagcatggcacatgtatacatatgtaactaacctgaacattgtgcacatgtaccctaaaacttaaagtataataataataaaaaaaaaaaaaaaccagccctgaaaaaaaaaaagaaagaaaaagacaacctggtaccaaacctcaaatgcttttacccaacagcagtagttctcaaaatttggcccccagatcagaagcatctgcatcggccactgagaaattgttagcaacacaaattcgtaggccccgcctcagaacctcagatctactgaatctgagagtctgggaaccaggctcagcaatctgcgttgtaataagccctccaggtgattccgatgcaagctcatgtctgagaagctcatgtctggagaacatctgggggtggggaacaggggtagaattcaaataaaaaacacaggagactgatttacacatagtggccagaaaagcatctcttaatagatgacagttgaacctgaaaaatgaaatggagtcagtccttgaaggataggaagaagaaaacaggatgagtggggaaaacattttagggagaagcggcacacagcagtgaccttgtgcagacaaagaagtcagcgtatgcaaagaactgatcaaaagaccctctggctggagcccagcaaatgagaagagaatgtaataagataagattgaatcaatgactccggagtagatctgaggtgcagagatggcaggaagcgaaaggatgaccctgacggacaagagctggggctgagaatggggaaaagtttatgatttcagaagggagggagtcactctgtagctgaccaaggctgagataggcagggccagagattttgggtgtaaaaacttcctagaaagtgcctttagcgataattatttgcagacagaattatcgtgaataagtaatcagaagacttctgagtttttgaaagactgtactatccaataaaccacatttccaagcttcaagcccctgccagtcttcagattgcaagagaaccctgggccccaaagcttatgctgactatgcagtgccaaaagcagcatattctgcaatgtccttttttgggtaaggtcatgaataatgtgctaagaacaatctcttgaagggatgagacagagggcacaaagagagtgaacaatggaattccttccagaaggcagaatcaggccccatggagtaaaccccatattctctactgccagcgatgggaatctgttattcttgaccagtaaaatgtgttaattgctatgaaatactttctggcctgtgtttcccatcctcttcctctccaaatgagagtttttattacagtttcctgtgccactgctccattgaatatggggtaatacagggcatggataacctgtcttttagtttgtcagtcaccaaaataagaaaagcaatacacagacccgggggagaggacgtgaatgacacaggcattctggacttcagttcagatgcagtaactggttagatcttcgggcttgcctccttttgggagcaggtgagtgtgttatgtgtggggtgaagaatacatacaaatacgtgtttggccgggggcagactgaagcagattgttggatttcctccagtattcgttcttctcatctttcaatgtaaataaagtcaccaacttctgactgagcatacgccacctgggataaatgccaaatttcccagcctgccttgagatccggtggggtcatgtgactaagatctggccaatgtggtaaaaacgaatgtgtcatgtggcatcaaccaggagatttccacagggacagctgtactctttggtcctcctctttttttttttttcttgagacgagtctcgccctgtcacccaggctggagggcaatggcgcaatctcggctcactgcaacctccacctccttggttcaagcgattctcatgcctcagcctcatgagtagctgggattacaggtgcacaccaccacgcccggctaattttttgcatttttagtagagacggggtttcatcatgttggccaggcttgtctcaatctcctgacctcatgatcctcccgcctcagcctcccaaagtactgggattacagggatgaaccaccacgcccggcctgatccttcttttatatttccccttcctctttcctgctgtcagttacccaaatattacctcggacaaagagccaggtctgtactcctggggtggtgtggtcatggaagctggaaggggcaactgaaaacatcttggagcaaagccttcagactgcatgtcttcaagactcttgtgaaaaaaatgaaaactgtttatttggaatttctgttatttgcaaatgaacttatcttaaccaatatggactcttggccactaaaagtagcttaaattttactccaaatgcactagcaacccatgagagggtttcaagcattgagcacaataggctctgctgtgttacaatacttttaactctgcaaggaatgatgagaaagaggatgggggtataggccatgtggaaaatggcaccagcaaatatggtggattcaggagggataaaggggggacatttttgataggttttagaggtaacatagtattttttgataaatttgatgagattgaagagaaaaataaaatattatctatatctcatggataatacaagtgatacttatttttatcaagttagttgacaaatagaaatttctctgggaaattggaaatatatgcatggcagatactcactagggtggctcccatgattcccgccccagcatcagtatctttgtgcaatctcctcccctcgagtgtgtgctggacctgtggcctgctttcaacaagagaatatggcaaacttgatggggttatcactcccctgactacgttatgttatatcacaaaggttgggggattttgcagattttgttcgagcccctatagagttaataaaaaggaatatatatactgcatgggtctgacctaatcaggccctttaaaaagcatctttctctctctctctgtctctctctctctctccccccacctccccacctccccaacacacacacatagagagagcgagagagagagaactaggccaagagcccaatgagcagaggtagaagtcagagactgcaggcagcaattactctctctccattgctggtttggaggaagcaggccaccatgacttctacagctgcaaggagatgaactgtgcccataacctgaagaagctaggaagtggatcgttcctctcagagccttcacataagaatgccacctggttgacatcttcatttcagccttgtgagaccctaaacagaggacataaactgtccccagactcctgacctcctgactcacaaaaactgtgaagtaataaatgggtgtttttttaagtcactaaaaagtttgtagtaatttgttctgcagcaataggatactatacatacatacatttatacacacatgtaatatatatgttatatacattaacatgtcaatgtagaaaatgatatacatgtatctatatgtgtatgttccttaagtttatcctccttaagaaaatcaagtccttttttcatccacaaatgcctgtgaatgtgacaatgtatgtctatgtatgtgtgtttctttttttttttttttttttttttttgagacagagtctcactctgtctcccaggctggagtgcagtggcgcgatcttgggtcactgcaaccactccctcctgggtgcaagcaattctctgcctcagcctcccaagtagctgggattacaggcacccaccaccacacccggctaatttttttgtatttttagtagagacggggtttcaccatcttggccaggctggtcttgaactcctgaccttgtgatccacctgcctcggcctcccaaagtgctgggattacaggcgtgaaccacccgcacctggcctgtatatgtgtttctttaggctataattgaaaacagaatattgctactttgactttactgatggctagtataagatgaggtcatttcttagttataaaattaggaatttacctattaaacagaagaaattcaattgtgtttcatatatgtacttgtttctgtgtaagaaatcgattatgtttcttcctatgtatgttcgtatgcgtgtgtgagtgcatttataacaagcatcctcaatgcttaggagggttctcaaccagccaatttctcacattacctcaactgagaacagatagctgcagcaataaaagaatatactcagatctcggtgggtatcttagagacatccctgatgaaatctcacaatgactctgggatagctaccctgggctcccttttcagaagggccaccgtccatcagcatggtgggggatcactatggccattgactaacagagacagcagcaatctcatattctgcttttggaattctcttgacatgctaattccatattatcaaatatatcacgggtatcatttagacttttctgtacaatgtgttccagtcaccactccgacttttgctttcaattatttcccaaagatttgaaataacagataaacttaattttcatttatatgcctttctctactgcctacttccttttatttgtcaaatgtatgataactctttaaaattaaaaaaatacatattttacaagtaaaatctgcatgaatcaaccttgagttttataattaggtgcaatcatgatttaatgtgtttagattctagacaacttctcaatcatcctaaagagatacacattagccttatacggagacagaaacagagaaagaaggcctgcaaatctcttacgcatttatttttataaacatatattataaacttactatgtatctgaggcaccgtggtggggtgtatagtctatgacctcaaggctaccatgttgtcatggaagaggcagactggcagagcaatgatgcaattacaaataagagctgatgtgcaaaaggctgatggagatctggagggagcagtgcggaaagtgacttgctgggcagtaggaaagatttcactctatttttgtagcacaaacacaaaatcaccccaattcctggggtaaaaattatttatgttgcattttaggtaaaccaatagtattcttaacagtctttaatttctgttttcttctttaaactctactgcatccaagcctacagaggactcaatagtagaagcaataatatcatcattttaggatagtgagacgtgattggtgataggagtaatctaattagacaagcaaaacactctggagtcatttaatatttcagtgtaggagctatcagtcctataaactttaatcatcaggaaaaaaattattgctttgctgcacactttgtgataatagccatgagtcattaaagtaaggttcaattatgttcattatgttctatttaaaacggaaagaaacataccatatttagaaatctttctgtccaatgagttatctttaaatactacctaaataggtgaccgtttcaaaatttcattcatcaaatatgtcatttgttcataatgttggaaaaataaaatgccaacatactaaaaaaaaatcacattacatttaaatagttgatagtggtctctaaagttttttcctaatttctcagcataattccataaggcagacattgtttccattgtgccactgaagcaactgacacagtcacttaaccttagtcatgtaagtcacccagttcttttaactcctataaatgctctttcatttatccatctattaattcaatagactcatttattgagcattcatatgacccacgtttcataaaataaaatggcagacagtttaggtaatcctgtaaatctacaattataacatgattcaaaatttttctggaggtggattttctagtaacaagtgattcctagaggactttaactcactttacaatgaaatactacctgccatttaattacaccagggaatacttcgggtattttgagagatagatggattaagtcggtaccctatccgtgagtgacacaggtccacgaatgggaagaactccagctttctctgtatgttcctcacataaccagatactttaaatgactttgtaattttttgttcatctctcagttcagcaggtgaaaaaacaaaacaaaacaaaaaaatcaaatcagtcagagctaacgcatcctgtggagaaacaaaaggactgactctgtttctttcttcaatgggctgtttgatattgtgtagatttagtgtctgtgctcttcttaaaaaattccacttaacgacccaaaaagaagagcattactttcacaatttaataaatggaaaactgtggaatagaaaggttaagtgagctgattatgctcagacaagtccttagcaacatagcatttctctgccagagattacatgagaagctgcctttccatgattcccattgtttatgcagtcattctgtgttgtcaaggcactttttgatttttgtcttctgtttcctaattctgccaagttattctttttttaaaaaaggcacagcacacgtggcaatctaaaatccagagtttttcttggcatcactgattatgcttttggatgaatgaacacaccgacttggatgaggaaaatgcaaaagaaaaatagtaaaatagtaaaataagagaagtattatgttcaatatttgaaataattacagtcactcaggaaaaaaataagagcatcttaaaatccattagctaacaggactaggagggcaaagaacagcatgaaacagctattggaatttataccttttttttaaactcacagactaaaccaagataccattcatagtttaaggctagggggatagcaaattggcctcacattagaaagaattgtccaggctttgaattgatagcccaaagacaaaacaaatctggctgtgtgtctaaagtcagccttgattttgatgtcagttaatttgcttgtgactttgaaaactttaaattgttgccatctttaacccttgagaaatgagtcatctgtttctgtaaagtagaaaaggacaaaatcagcaagaaagaaaattttattttcaaagttcaaagagaatgcaataagtagtggagatgatttaccagtaactgtgctattgtttttctcaagagtttgaaatactctcttaaggaacacaaaaagcaaacaattttaagaataattgtagaagtcaggttttctttctctcaaatttttgcaacaagagaaagccgaggaatttgcttggcataactataaaggaaagcatagagcagctattgcaattttttttaaagacatgattagaccaccttggtatcttcaatacagtttccaaattattttccttgtaataaataattcatgatcagtattattatcctaatttttcaggtgcataaactgaggcccataggtttttatatcgctcaacaaagtgactggtttccaaggtgaaggtctaggatctgagccctactctgtgactctgtgaactccatcctctgacctctactctagctcacttcttccagtgaatcttcatactttgattgcctgcattgtactttcttttcctatacaaataaagatggcttgcctgtcttactcaggtcatggagttgttataaatatcaaatatcacaatgtatgtaaacatggtttaggaatttaatagtgaagagtttttattttaatgcatatagaaagcatgattgattagtctgaaactggttgtttggatttagagcagctattttagtggtaatctgaaaactacctgccaaacacggtggctcatacctgtaatcctacaattttgggagatcaaggcaggaggattacttgagcccaggagttcaagaccagcctgtgcaacacagtgagaccctggtctttacaaaaaacaattagctgggcatggtgctgtgtgtctgtagtcccagctactcaggaagctgaggcaagaggatcacttgagcctaggaatttgaggctgcaatcagccatgatagcaccattgtactctagcctgggcaaggagcaagaccttgtctctaaaataaaaaataaaaagaaaattactaacctttgcttcctgcccctaccaccacttactaccctcccatagtcaagctggagaattccagagatttatagtaaatcttccccatattcccattcttccaggacacactcagctaccacacctacccatactttacctggaagaaggatgagtgtgaaagcaccattcatgcttctgattgcattttaacctaacactcatgatatacagagtttgaccagtcaaagatgcaaatcattcccaaatgtgctgggttcctgtgtttaatgagaattataggacttgctatccaccttgaggtctgctggagataaaccaaagaaaaatatgagcaacagctctttttcatgaataggttgaaaacttgcccaataattcttagcagttctaggacaagacccaattttctacttgcagccttgtttgaggtcccaggttgaaaaaattaaaagtcagatactgaagcaccccaccaccttgattcacaaatgcagtttctatgtgttacaaccagaatcaggatgcaagaaacttcaggacaagaaaacttgactttgtccaaagtgtgattttgtcagagattaatgcttctgttcccaataccaagtaagaaattgattggttcagatccacagaatgagaatgaggaggcactgatgctgctgagaactcagtgcattgcatgtcacacctaaagcacacatttatttttaaagatctcaactcaatcattctgtttgccaggcactgggctgtgagctttctatgaagtattttaattaatccttaacaaacactttttatgtgggggctatcattttacacatgaggaaacagctagtggatccaaagctagaacacaccccaacactgggctatttgcaaaaagttagcaaaaagtacgtatctggggacaactgcttccttctcccctatgcctttgtgatcagaaggagtatttctatgagaggtggtcctgtgagtgtatgatgaacacttaaaaacaaactataaagctccttttagtgtgttcagaagcgaaaatgttttctatgtgttactagactccaattcacagaattttgtttttttttttttttttttttttttgagacggagtcccgaactgtcacctgagctggagtgcagtggcgcaatctcggctcactacaacctccgcctcccaggttcaagtgattctcccgcctcagcctcctaagtagctgggattacaggcgcccactaccatgcttggctaattttttgtattttttgtatagacagggtttcactatgttggccaggctggtctcgaatgcctgacctcgtgatccactggccttggcctctcaaagtgctgggattacaggtatgagccactattcctggctcacagaaaatcttagaagggagatatatgagaaaagagaagggatcattgtctcctattacacattggaagctataacattctctagcatttttataacataactgaaagcaaagcttagaagtcagtggtgggagatgagttcgctgctacagtgtaggtacttcagccatcacagatttggatgggacttgtctggttctctgagtgccagcttccttggtcaaggctccatgaatggtctcccaggactccacacatacagaagaggtcaaccactgcagagggaagaccaggctttattccaaggtttatgagttgttgcaggcctcaagatgcttggagactaggaagggaagtggacatctgtgtcaatgccagaatgctagccagaccatgataaataccataagagggcactaggaaaatacaagcattcacagaaaggagtgtgcagagccatggtggagggaaatccaccacagagcagggagaggggcttcagctgtcactcagagttaaacctggaaaaatcagatgtctacgaagactgaactttatttagcgatgggagcagcaatagttggagaggaggaaaaaccattgcaggaaaaaggaacagctacaatcaaacacatcaagacggaatgtatgggacaagtgcagaggcccatttagctaagaagaatagtgaacgaataagaacagctaaacatttaaagagcagtgattctttttgcaagtaatttacatgtagcatcttatttggtctgctataaagtaggtgctatcagtataaggcaagaactatcactatagccactttacaaataggacctcggacttaccacctttctatgagaggaggtcctgtgagtgtatgatgaacacttaagtcaactggctaatctgcctagacagtaacagagcagatgcagcctgctcccaggtcccctttgttattatgacttccttttaagtacaatatgggagataaggttgtgaaggggagttgtggccagaagtcaagagtcctggaacattatcctaagataggatcgagaagcatagaaagccttgaaaatgttcaacaggagttagatatgatcagagctgagctttggaaagaccgaagctatccaggacattattttaaaaactgagttactagtttgcttgcttgcttaagcccccacttcaaggatgaagggaaaagtgctgatagttatttctgggtcagtgtcttctgagccagaatcctcaagtgcatttccccactccctctacactcattttagttgcctagaagagtcttacaaagttttctaattggctgaggatcctaaacccggaaacaataaatgaaagtctgagatttgggctcaatcaatgtcacaggaaagaaggcactggggcttatatttttacataaagatgctgcatttggggtagtcaaagctcacacattctgcagtcacccccattacaggaaatggtgggccttggatatggctgactgtaatattaactttatgaggaaacagactctgctctgaagacttatgacctgagggaaagatggacaaacagaagaccaaggcctcatggtgggctcctctgatagcctcctgtgctgctttcctcctcagaaatactgaggttggacgtgaggcactcttcagcaaaaggacatttctgcctttccagcactaaaatggccatgagtaaaattgatatgtcaccgtctcaccaaagtgaaaaactgaagcggactcctaaggccacgcatggagcaaaactgtttatgcaagaagcatttactgagcacctgctgtgtgctctgcttgattgacttggatgagaaccatgaacaatatgaacaagtgccctgccctcaagagtcttacattctagggcaggaggaaagacacctgtaacaatcaagagataataaaatgtctgtgaaagtaaaatcagatcaggtcataaagtaacagagcagtaggctactccacagagcttgccaaggaaggcctccctgaagaggtgatgtgtgagcagacactggagtgacgagaagaagccagcgtgcaaagggccaggcaagcacatctgatggagagagttcagcaagtataaaagcctcaaggcagggaatgtgtttcccatgttcaaggaaaataaggaacaggagcctggagcgtagacagggatggcatgtacaacagaaaatggaagtaaagggggccccactggccagatcatctagggccgtatttataaatttgggttttattgtaaatataagaagccccttgagggttataaacagtgatgcgactagtgatattaatagtattaaaataggactgtgcatgttgagtgcagaatgaatagcacagaagcaaatgtggagacagagagaacactcaattgggtactgcagaagtttaggtgaaaaagcctggtggttttgactaaaggtggcaatggggaggtagaggaatgagcagattcaagatacatttttggagacaaagacaacaagacttcctagttgactgaaagggaggtgggaatggagaaagagagagtgattaaagataattactaggtcttagtcttaagcttaaacaactgattggaaagtgtcatttgctgagtcagggaaaagtggggaggaaaaggagggtcgagaagaatccagaggtccaactgagttgccttatgtttgagatgcttactggtaaaaagacagatatgtgaattaggtagttggatacataagtcaggagtctaggacaggaaaggcacagtggctcattcctgtaagcccagcactttggaaggccaaggcaggaggtttgctcgaggccaggagttcaagaaaagcctgggcaatatagtgagaccctgtctctacaaaaaagatagaaaaaaaattagttgggtgcagtgacaggcatctgtagtcccagctatttgagagactgaggtaggaggataacttgagcccaggcatttgagattgcaataagctaggatggtgccactgcactccagcctgggcaacaaagcaagaccctgtctctaaaaaaatgaaaaagtaaaaaagaaaaaagaaaaagaaaagattctaggagacagttgagatcgctgagggttagagacataaatttgggaatcgtaaaaatttggatgcatttgaagccatagaaccagctgtgatcactcagggagagattaaacatagagaaacaaccagggcccaagagtaaacccagggagttcattcagcacctgtaggttcgtagaaggtgaacagtcagcaaggaccaagaaagtagaaggaaaaccaaaagggtacaagaacacagaagccaagaaaagaaagtgttgtttcaggaaggaggacatggtcaacaggatagagagagtgattaaagccaattactaggtgacatgttgcctaagataaaggcagttttgagctccttcaaaggtatctgtttcctttgttttgatattgtttccaaaaactacatatcaggtttgatacgataccagaatgcagttaaaatgtaatcagtttatttactcaagatgtgtgggattatagaaacattttatcaattaccatttccatttataacttgtgcatcagttatagatcctattgtaagattgatatgcagccaaactgtgctatatactttcagtgttcactgtgtaagatactaaagggcttattacactgtagcccagcctaaagacacatgctaattatcttccatcatggtgcctgcactggctgtacttctactgaattgtaagctctatcatggtgggcacgtgcctgatatgttcaatcaaacaatagtttaatgtttagtatgtttgtttgtttgttttgagacagagtctcactctgtggcccagattggagtgcagtggcacaatatcgactacctacaacctccacctcccgggttcaagcaattctcctgcttcagccttccaagtaactgggattacaggcatgcaccaccatgcccagctaatttttttgtgcattttaaatagagacggggtttcaccatgttggccaggctggtctcgaactcctgacctcaagtgatccttccgcctcggcccccaaagtgctgggattccaggtgtgagccaccaggcagattttttaaactttggctgataaagtgatttaatcattaatcagtcagtgttaagagattagccctcccattggacatgctgaaaacaggcagctggcgactaagtgaagtctcacaggcagaacatctccactaaatcacagtctagctccaaggaccccttgttattcataatatttactgcatatttagtccccacaagctcatgattaattactgcacagattcggatggacaacatgtgacctacagtttccctctgcacagtaattgtagagggaaatgtaataatacccagtcagtctaaaaagcctattagtccaattctccacaaaattccatgaaaatataacatcacagcctgttgacttccaagaaatagtttaccaagagttgccataaacattagtacattttagttttagtgatagggtacttggcaaatatacataaaatcatacacacatgaggcactttgataggcactgaaaaataaaagacatacttcctgatcttaaagagtcctaaaatctagttgggtagatgcttttcataacatgaaaagctaactaatagttagacattgaaatgagaaaaacgaaatgttatgaggttctatagaattgacagctattgatgtgggccaggtatgagatggatatgaatcttcagtggaatctctgataaacacagaaagtgggccgggcgcggtggctcacacctgtcatcccagcactttgggaagccgaggcaggcggatcacgaggtcagatcgagaccatcatggttaacacagtgaaaccctgtctctctctactaaaaatacaaaaaattagccgggcctggtggcgggtgcctgtagtctcagctactcgggaggctgaggcaggagaatggcgtgaacccgggaggcggagattgcagtgagctgagatggcgccactgcactccagcctgggcaacagagcgagactccatctcaaaaaaaaccaaaaaaacaaaacaacaacaacaacaaaaaacacagaaagtgaaggataaacagagtaacataaagtatgtgtgtgttttgttcttcctcaaaataaaaaattatcagtcctagactattttatgtgagaaacccaccttgacacctgtttctcattgtatggcaactacaaagaagtataatgctgaacagtgcatctctagagaacagcttccatgtgggacagtgtttccaaacagagaatacattttctatccctgtaattactcttctattataataagatgtcctttgacacacagaatggcgttgtagaggagcactagatcaagagtcaaagggtttcagaactcctgactctgctgtgaatttgatgtgtgtccttgccatggataggacagcagcgcacgggagtcaagagctctccagacatacctgtcattcactatttgtgtgattgtaggcaaggcatttcagctttctcagactttatttcatcatctataaattgggaagaacagtgtctccggaaactccaatgcatgttagtaagtgaaggaagccaatccaaaaaggctacctactgtatgattccaactacataacattctggataaaggcaaaaatatggagacaataaaatgattagtggttgtcaggggttagaggagagggatggatgaatcggcagagcacagaggatttttaaggcaatgaaactacctcgtatgattctataacggtggacacacgtcagtgtaaatttgcccaaactatagaatgtacaacaccaagagggaaccctaatgtaaaccatggaccttgggtgataatgatgcctctatgtaggttcattaattgaaaaaagtgtacctctctggtggagtatgttgctaatgggggagattatgtacatatacggatacggggtataggagaagtctttatagcttctcctgaattttatcgtgatcttaaaattgctctaaaaaataaaatacatttaaaacaatcataaaagaacagtacttcggccatagagtagtaataattaaatgcgataaatatgtaaaggacagcacagagcttcctaaatagtcaatgttcaataaatgccagctattactctgatcctgtttcttagcatacagcagatcaaaagctgctgactggaattaaaggtcagagctgctagaagttatactgatggtggccagatgttacaggaggatacagaagaatgctaggaaggaagcatcagaactcaggaaacatttcttccaaggctatacagggagggagcaaataatggtctctttgttttttgttttagacactgggtctggctctgtcactggggctggagtgcagtggcatgattatgactcactgcaacctccacctcctgggctctaacaatcctcccacctcagcctcccaagtagctgggactacaggtgcaaaccactatgctgagctaatttttaaaatttttctgtagagacagggtcttgctttgttgcccaggctagtctcaaattcctggcatcaaacaatcctcctgccccccaaagtgctggaattacagatgtgagccattcctggcctgctctctatcttaacagatcaggaagcatcagtaccgtgcagagtcacaacctatagcattgtgatgtaagaaaagcaggaacatttgcctaagaagggctgggttggaattcttgctctctgttggtcccgtgctaattctgggtccttgactaagtccattcacgtccctgaactggatccctgccatcaccatgcgcaataggcacagctcagctactgtccgctctacctcagcagacaggactaggacctttctggcccagcccatcttgttgtaaataacaaagcatgccccataggactccaaagaataaaaaatcatactccatttgtcacagctgtgataatcactcacttttgctctaaaaatggagacagtatgcacctcaccaggcaactgagagaattgaatgaagtcatggcttacaaagcatttgggacacacaacccccagctccgtcaatgttagtgtggctatgaatgttttctaaatgataattcacacgctcaggtgccagcatagagctatacttgctactattctgacctgggtattgtgcctccgttttgaaaattgagtattcatcccgttcctgagccttagtttttccaggtcttatgaactggcttcttcctaacccggcatctcacgctttttttttttttttttttgagacagagtctcgctctgtcaccaggctggagtgcagtgatgtgatctcggctcagtgcaacctccgccttgcgggttccagtgattctcctgcctcagcctcccgagtagctgggattacaggcacatgctaccataccgggttaatttttcggtttttgtttgtttgtttgtttgtttgttttagtagagacagggtttcaccatgttggccaggctggtctcaaactcctgacctcaggtgatccacccgcctcagcctcccaaacgtttttctttttttttttttcttaaagaaagaatggaaaaatgcatacataccgtgctctggtccacatttatttgctttcattttggtaatcctctgggtcctgctgtgtgcttgctagtcccttatccagagcctgaagcccagactcagaacacagtctgctggctgggttcttctcctcattagagatcgcccaaataccactctcattgcttggacatacaagtagaccatgtcccacctctcaatccttgaacttcgttcatgtggtaagataccctattacactatttcttctgaaaatttccattactaattgtttccccgcataaatgattgcagtatgatttggttgcgtgcctatctatggcactcaattcccactatcagcacctgcaaaaggctcagctcagtcaccacgtgctccatctgaataggcaggactagaacctttctggcctggcccatactattgcaaataactaaacaggccctgtagatacccaaagtacaataaatcatgctctgtctcgcagctgacatttcccctggaattcaacagtctagatatatcaagtagatgggtgggtcaggtctacaagaagtctatctacatacacatggtattgaaaagtctcctgtgcggaaaagtcactctcagagaaaaaggagtcaaactgggtcaagtacaaaacttatactatagagaagagacatgcttctatgagttcaaatctgttttccagtctaggcctcccacatattcccacctgaattctagtaagagagtaagagaaagaggctctatgtagtaaaacagtggaatgcactgtagggccacatgggaaacatttggaaaagtaaacagtaaggagagaggggtattccctctacttctgtaccgccttggcacacgaaggacatcagagaacctggcatctcttaggcattcaaagcacattggtggcattatcgtcaggaaagagacagcagcagctaaaggaagtgacagcaacaccctgttgggcagatggacagaacaggagtcgatgggagtcagaactaccctctgagagtagctcacctgtggatcctggaagcaaaggcgaggcattttcatgcaactttgcacccatcaacaacagagaaaggaagcttataccaggaaaagtagagaaataatgaatgtcatttattcagtgactggattattattgcactcagtgataataaacatcctgcctaattgatcagcagaaaaaaaaatgtattgagtgaagtagtctagggatcatgactccacaattattcattgagctcaagagccaataaaaacatgattacctagccactctgttgacgacagcagaaaaattatattcatgtattcatctattcatcatttaaaaataacctgtaagtacctaaccacacatcaggttggtatgacaaacaatgtggaaacagatgattaagttattctccaaaggcatctcataggtaatgatatgcaggttgagcatccctaatttgaaattcccaaatcggaaatgctccaaaatccaaaactttttgagtgctgacatgaggacacaagtagaaggttccactttatttcctgtttcacacataagtacttaacacaaactttgtttcataaggatgtaacacaaacttcatttccatttatttaaaatattgtataaaattattttctggctatgtgggtaaggtgtatacaaaacatcaacaaattttgtgtttggatttaggccccatcccccaagaaatctcattatgaacgtgcaaacattccaaaatccaaaaaaaaaccccgaattcaaaacacttttggtctgaagcattttggataacagataggcaacctgtacaatagaatttcaggttccatgacagaaatatatttgaagagctataaaagcttgaattaatctactgaggaaaacagcagttcatagaagtttgactgaggaagtaacctttgaattggacattcttaagcagaatgaaggcaaaagaaaatattatggaagtggacttttgcaggaggtaatattctaaagtatgtccacaacagaaaaatcaggtaaagtttattcttgtacattccttaaatcatccatgaaatatacatgaatttgtgtgtataaccttatagcatttttaacattaaactttgagaaccactagtcaggtctaaggacatcacaagaaactgtccacatggtctacgtataaagatcattctgcttttaagataacttcttaacaagaaataaacagaaatttctattgtttctatttgtctgaagggtttactctattttattttaatatgaaatctctatgaccacctaacaacagaggttcaaaattcatgaagcaaaaactgatagaactgaaaagagaaatagaaaaatccaaagtgatgactggagatttcaatttcaaccacaatttctctgcagttaatagaacaaataaaaaataggtaaggatatagaagacatgaacaacagtaccaatcaagtggatctaatgtctatagaatattctactcaacaagaacagaatatacatttttttcaagtgcttttagaactttcaccaaattagaccgtattctgagctataaaacaaactttaacaaatcatgaaaactaaaaatcatactaattatgtttcctgcctgaaagatcaaaatagagctcaattacagaacaatagctggaaggtcctcaaatgttgtgaaatttaaaaacatgtttctaaataaccataagccaaagaagaagtaatgaaaaaattagaaaatattttgaattaaataaacacaaaaccacaacatattaagtattgtggtatgcattcaagacacagcttaaatgaaaattaataccaccaaatgcctaaatttttaaaagagcatctaagtttccatcttaataaactagagaaagaaaaacaaattaaacccaaaacaaacagaaggaaagaaataacgaagttaactgaagatatcagtaaaattgaaagcaagaaaacaaacaaaaccaacgggaaaatcaaaatctggttctgagaaacaaatgaataaaactgacaaatttctagccagattgaccaagataaacagagagaagttacaaattatcaatatcagggaaaaaatgggaaacatcacaaagacagcatcaatatttaaggaataataaaggaatgtcacaaactagatacttaaccacactctgactcactcaaaaacattttatgctcactcaaaaacctgcttatgaaagtttatagaggatttattcataatttcccaaatctgaaaacaatccaaatatccttcacctggcaaacagataaacaaatactggtacattcataaagtaacatagtttcacattttgattaagtccaatttatcaactgatgcaaaagaccacaagaaacaacatctaagattgttttttttctagcatttttacctgattgctatggctcttcttcaaacttcttttccctcaaattacatttcctaaccatatatatatatattttttttttttttttttgagacggagttttgctcttgttgccaggctggactgcaatggtgtgatctcggctcaccacaacctccgcctcccaggttcaaacaattctcctgcctcagcctcccaagtagctgggattacaggcatgcaccactacacccggctaattttttttttatttttagtagagacggggtttctccatgttggtcaggctggtctcgaactcccaaactcaggtgatccacctacctcggcctcccaaagtgctgagattacaggcgtgagccaccgcgcccggccatctaacataattcttatccagtactagcatatggctatgacaatggattcaatgttggataagacagaaatgtaagcagatgatgggtcttgaggtcttttgcgtcaactgttcatttgccaagtaacatgattcactcatattattctcatagaaacttaagctcccttaataacaaatcctacatacttctccagaatgccaaacgagaatagattttctagtttagaaatgagaaaattgtgacaatttttgaagtactgaaaaggttataatcagaggaaaggacccagtataaacctctgtgatttttttttaaagaaggcaaaaaaggaaaggcagatgttgtgaaggagtgaaaagagaaaaagggagagtgtagtgttacataaaatctcaatttaggctgaacatccaccaagattctactggaaatcaagcattttactctcatttcatttccctaggaatcctgtgaagtaggtaatagctctccatttatagatgaggaaaattcagtttagagtgataaatgacttattcaatgctacattgctagttaagtgaaggaggtaagatttacactaagaattagagattatacactttttttcaagtgccacttttgggagaaaaaatgattaaatatcagtataaaagtattattttgaggaaagaaggctccttaaaaaggtactccagttgtttggaataattgcagtctcgtttcagtctcagctctatatgcagtacagctcaataaagctctaatatgcagtacagctcaataaaggtggaatgccaaagttctcatcttttagcctcatggctgttgtcccacttaagggacacagaatggctttataaagaaattaacattaaccaagtatatactgccacttatctctcttgcctcatttctcaataaagaaacctgaaagttactttctatggctagcttcaccttgaagcatgtttgttttatctaataaaggaactgtttagcttaattccattactgattttggtgtcagatcacacgatataagctaacaaagatctacttcactgattgcattgcaacattatctgaaaataaaagtggggtaggaagggaaggagaagggagagatgaagagaggatggtaaatgggtacaaacataaaactaaatagaaggaataagttgtagtgtcagcagagtagggtaatgatagttaaaaataatttactgtatatttcaaaatatctagaagatatttaatgttcccaacacaaagaaatgataaatgttttgggagatggatatccaaattaccataacttgatcattacacattgtatgcatgccatcaaaataccacaggtaccccataaatatatacaattattatgtgtcaataatgaaaaaaagttagagttttatataacttctattatagtccttttcttttatcctcacacacacacacacacacacacacacaaaaagagacagaccttaaacaattatacagaaagttgtctacaaggatgttaagagtaataaccaatctactttttaaatagttgagtgggttttcagaaaaaaaagtattcaataaacaggaaatatgtgcaagaataaaaagagaaccttaattataattatgtatttcttttcagcagagtgttaaactctggtaatagaaaaaatatatttttttcttttaatccatggacattttatttacaaaatcttatgatcataggtttattaatgatcctcagacgttttactacaaaaaatgcttgagattataaaccacgacagaaacaaataaaaccacctcatgatagtcttggaacactaagaaaaagtcctaagactaatattaattgacttctatggtcaatggttctctgacattattgtgtgaccttaggtagtaaattagccactccacaaatttgtttacttatttaggaagagaagtagtaagaattcctttcctattaccacctcaaataattattgccaaattatatgaggaaatacacaccaaaatactttgaaggcttcgaaattcagcagaacttcaaactatcaaccaaacaatatacgagtgctccagttcctctacattctcaccaacatttggtgttgtcacttttgaatttttttttgagacagggtctcactctgttgctcaggctggtgttcagtggtgcagtcatagctcactgtggtctcaaattcctgggctcaagcgatcctcccacctcagcctcccaagtaactgggactccagacacatgccaccacacctagctaattttatttatttgtttatttttttgtacagacaagagtctcgctacattgcccaggctgaactatttttattttactgttctgataggtaggtatgtagtgatatatcattgtgattttaattgttatttccctaggtgttggacatctttttatgtgcttatttgctatctgtataactttggtaaaatgtttatttatatctttgcccttggtctaattgtttgcattcttactgttgtgttagaagttctatagtctatattctagatactagtcctttgttagatatggggtttaccattattttcttccggtctctagcttggcttttcatccttacttaacaaagtctttcacagggcaaaaggttttaattttgataaagtccaatttattcactttttcttttataaatcatgctttcggtatcaagtcttagagctatttgcctaggactagattctgaatattttttgctttttctttacactttttataaagttttacattttacatttaagtccatgctccattttgagttaatatatttaaagtttgtacaaggtgtgagacttgaggttcatttattttagtctatggacatttaatcgctctagtatcatttgttgaaaggtgatgtttccttcattgaattgcttttgaatctttgtccaaaaaatcaattggtcaggctgggcgcggtggctcacgtctgtaatcccagcactttgggaggccaaggcgggcggatcacaaggtcaggagatcgagcccacggtgaaaccccgtctctactaaaaatacaaaaatttagccgggcgcggtggtgggcacctgtagtcccagctactcgggaggctgaggcaggagaatggcgtgaacctgggaggcggagcttgcagtgagccgagatggcgccactgcactccagcctgggcgacagagcagactccgtctcaaaaaaaaaaatcaactggtcctatctgtatgggtatacttccacaccatctattgtgttccaaactatctattctgattgctagtggatttatgtgtctgttccactgataatcttgatactatagtgacatagtaagtcttgaaatgaggcagatttatttttatcacattatttttcttttcaaaattgttttagctattttagttcctttgaattttcatatgaattttaaaataatctcaatatttataaaaattttgctcatattttgataagaattatgttaaatctgtatgtcagtttgtgaagaactgagactttactatgtcgagttttccaatcagtaaaaattgcatttatgtccattaatttacattttgtgtgcttcctttgattagtactgtagttttcagcacacaagctctgtacattttgtaagatttacacctaaatatttactttaaaatgtttctgattattgtaaatggtgttataatttaaattttgattttcatgtgttcattgctatgataaatacaacagatttttgtatgtttatcttctatcttatgaatttgctgaacttatttatcagttctgtggatgtttttgtagatttttttcattttctatatagacaattattccatctgaaaatggtgactgttttttttccttcctggtttgtatgccttcccccagccccatcttattgcattagcaataccttccagcactatgttgaataaaagtggtggaacctgtttctaattgaagggaaaaagctttcaggttctagccattaagtgtaatgttagctgtagttttcttgcagaggggatagatgttctttatcacgttgtgaaaattctccgctattgccattttttttttttgcgacggagtcttgctctgtcgccaggctggagtgcagtggtgcgatcttggctcactgcaacctccgcctcctgggtttatgccattctcctgcctcagcctcccaagtagctgggactacaggtgcacgccaccacattcagctaatttttgtatttttggtagagatgggatttcaccatgttggccaggatggtctcgatctcttgaccttgtgatccaccctccttagcctcccaaagggagggattacaggagtgagccaccgtgcccggcctccactattgttatttttatgagaatttttttatcataaatgagtatttaatttttttaaatgctttttctgaattagttgatatgatcatgtgagcctttttttctttagcctgttaatacaattaaacacattgactgattttcaaacaatgaatcatccttgcatttctagaagaaatcccactttgattatgatgtataactctttatatgttgctgaattctatgtgctaatattttgttaaagacatttttatttatatttaggagatacatcgctctttagtttccttttttgaactgcctttggttttggttcaaggtaatactacttcataaaatgatttgagaggtatcttctactcttttgtctggaagagattgtgaattggtgttaatttttctttaagcttttggttgaattctctggtgaaatcatctggacctagatatttctttttggggagttttagattataaatttaagttccttaatagtcatagggccattcaaattctcgatttcatgttggtttacttgtaatttgtttggaattggcctgcttcatctaagttgtcaaattcatgtgtatagagttgttcatatgcgggcaggggtgcctcactaccatctaacagagatgtaaattcaggctccttcctgggctgcctctgttatcacccaggtgagggtgtttggtctcaacagagcctcacaaaggtcaaagtctacgttttctactcaggctttgctaacatgagcagaggcggggccaaacttctttctgtggtgtttggctggaatagaaaggttattatctaaaagctccatatcttgccagcctggccctttcctgatcatttggctagagaaaacaggtgtgtgtgtgtgtgtgtgtgtgtgtgtgtgtgtgtgtgtgtgtgtgttttgctttgattttgatttggcttggttttattttctgtctgcacgtgtgtgtgtgtgtgtgtgtgtgtgtgtgtgtgtttggtttgctttgattttgatttggcttggttttattttctgtctgcacctgtccgcatttccaggattctagttctttagcattaagaactcactgccatgtggtttttcaggtcccaaaggccccagctcaaatgtttcttttctccacttttcagagtcctttatgtatattttatgtataatgttcagaatttttacttagtgggatgaaaaggcaaagaatgcctacttcagcttctagaaacagaagtcatccaggatttagttttaaatgaattggtcaagatgaatttctggtacataaaataggcctagtcaaaacatgaataatttatccatgaaacaaattccttttcgtgacatttttccttggtgggccaatctgctattccccatcagaaaagagcccaggtgagagaagaagaaaatagaagaaaacagaaaatcaggaggactttctctttctcactcctcacttcattcctgcctcactcccaaggcaagttcagagccccacagtaccaagagttcaggaaaatccaagggctgaattcaacatccatctagccagtagagatattttaaaaatcacacatattatactgacttgaaaaaatattttcagcacctactttttaagtactcttatgctaaacacaatggagaaaattaaggtacaaaggcatagcctctttcagaaaatccataaaacctgtatccaaagaactataataatgggcaggttctgaagaatgacatagaatgggccacacatctctaggataggatttaaaatgtcatttaaatataacacaaatgtttgtattgggaactctaaattgtccttgtctacagccttcttccttccctttcttacaacctataagatcagacttaagtaaactcctaagctaattttgaatcatttgtcctccctaagcccataatcacatggctaagccaagaattattcaaacctaattctcccgcaagacctcatccattgctcactgctcctgaagatggtcttgagtatccccctggatctgggcctcagactgtctttgccactctcctgtgttaccacatggagttggtccccgccatgtttggtcaggtctcttagaatgataacttctaacatcatggatcctgaaaattagctaatgtgatttccaactactgtgtctcatctagctgatattatcaatcaattcatcctgcctgaatttataacaccacatttggatatagtgtttagttgcttaacatatgttcaataagcataaattaaatacatatagacaaatggtctagagcagtcttcatcatgcttctccggaaggatctagagtacttatacaatttgagaagattgagtttcataccaagtagggacagggtctggaaacaggcagtacacaaacacttgaatgtatgttaagactgagacttctgctacagaaagtcagaggaaagaatgtgactttcaggtgagatcagcaaagaaggattccctctgccacaaaataacaccttctttcccagaaactcagatttcctttgatataattcactattaattttcactctaggagatgaagcatctgaatgaatgttcctggaatatgcttggaacatgggaataaatcatgctagttgatatggaagacaaacacaacactccagcaatactctcttaggaattccctcatcaccatttaaattgttgattttctgctcttctgtagaaatctctagttctggatgaacataagcactgtctatattcgttagacagcacaatacatattagtctttaatttatttcacctacaccaaacctaaattttttcttcttctaactttatgtcctaattttctttacttaattttgtctacatttttgtcatcattttctcttagatttttgttcagctttccttgaaacccaataaaagcaaaaattatattgagaaaagacaaaatttcacatcccatattctacagcttgctacctctgggcaccaatggacattcaactgaaatataattttttaaagaattttatcagtataatagactcttggacttgaattatgaagcctaacaactggtgctaaatcagatgaaattgtgaagaaatgtctgcagtgtagctctaactaaaagctatattctaacaagtcggcgatggagcctccaactttctcatgcctctggatggaatttattccctaaactcagtaaagccactgactttcagaaaatgaataatctaaaaaaactgcaaaggcaaggcttttgttctttaaaaaaagaaatgaagctaacttctgcttatggcaatggagatcagtttattttgcaccaatttcctactgaaaataactataaaggctgaacaaaatgtccaaaacccatctgtttgaagtcatcagagagccatcaaggtaaagaggggcttcagggcaaataatctgacagaggcaagccaagagatgttcaccccccaaagcagttactaaaggcttggaggttgacaggagtatttaaaagtcgcactgagaaggacaacacaaatttgagtttagtgccttccaggaatgaaaaatccttggataaagacttaggatatcactctgcaatctacagggcttcaccctgcaagtgagtgtaaacagaaaatagaacaagccttataaaggtttaagaaaagttttaggtcagctcaagtcctaaaggattaaggtgattggcatctcacttagctgcctggtagaagcaagttgaagtcccacctggagaaaaacattcactgaagcctcaaaatgccttgcaagttttcatctaaaatgtatgacactcaatgaaaaattaatagcatattaaatagatttgaccagcggggcgtggtagctcacgcctgtaatgccagcactttggaaagctcaggtgggcggatcacctgaggtcaggagttcgagaccagcctggccaatgtggtgaaaccccgtctctactaaaaatacaaaaattagctgggcatggtggcgggcacctgtaatcccagctactcaggaagctgaggcagaagaatcactcgaacccgggaggcagagggtgcagtgagccgagatcgcgccattgcactccagcctgggtgaaaagagcaagactccatctaaaataaataaataaataaataaataaagatttgaccagctaacaagagggaaagaaaaccagacagtgcaaaattatccatgagaaatgcagttgttgtatttatctgataggacttaagataacagtgattaaaatgtttaaaagattaaataaggcaatacaattcagtgaagaacaaaaaattataaaaacaaagaaaatataaattctagaactgaaattaagaactttacagatagatgtaacaataagacatacaggactattgaaaaaatagtgaattggaagataggtcagaaataaatattgagaacaaaagagggagaaaaaattacagaaaataaagaaaagagcatgcaaaatttatgggacaggtacaatgaaaagatctaatacacatgtaactgaaatttcagtaagacaatgaaaagaaaaatggggcacaagcaatatttgaaaagatagttgctgaggatttttccaaactgatcaaatactttattcaagaaatgctatgagccttaagaagaaagaatacaaagaaaaccacatagctagatgcatcatagttaaatttctgaaaaccaaagtcaaagagaaatcttaaaaaaagaaagagatagagaaaaaagtgtattaacttcaaaggggggacaataagaatgacagctaatagctgacttcttaattgaaacaatggaagccagaagacagtagaaagatatctttagaaaggggtgggggcagaggtcaacctgtaattatgtatcagtattaagtgcaatacaaaaattcacaaaataaaagcattttcacacaaataagaactgaatgcaccagcagcagatgaacagagaaaatactaaaggatattcaagaagaagtaaatttgtactaaaaaatgtgtaaaaaaaaaccccatctgtttgaagtcatcagagagcatggagaaaaacattcatttaagcctcaaaatagcatattaaaaatatttgaccagctaacaagagggaaagaaaaaccagacagtgcacacaaatatccatgagaaatgcagttattgtatttatctgataggaactttaagataacagtgattaaaatatttaaaagattaaataaggtgatacaatttattgaagaacaaaaatttggcgatgcagaaaggaatgaagagtaactaaaaggagtaaatatgtggataaacacaagtgaatattgactataaaacaataatactaaagtcttatggattcttaagtatttagaaaattgtaacacatgagaacataaattagagtatgggtaaatgaggctaaagtgtattctaacttttgcattgagttggtgttggtaaaaatagtaatttatgttagacttgaatttcagggatgtattatatttcataagctagggtaagcactaatacaatggtaaaagaatgtgtatctgaccagctagtactggggagaaagggaaaaataaataatactgaatccatccaaaagaatgtaaaaaaaaaaaaaaaagaacaaataaggaatatgctgggttaattagaaaataaatgtaaagttctagattttaaacttaatatatcaataacattaaatgtaaatggactaaacactccaattaaataacaaacattttcaggctggatttaaaaaataattatatgacacaagagactcaccttaaatataagaatataaaaaagttgaaactaaaaatagaaaatatatataccataaaaatactaatcaaagtatctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatcaaagtatcttaatctcaaagtagatggtatagcaagaagcaccactagagataaagatcactttccataatgatagaacagtcaatccatgaggaagacacattttaaaacttgtgcacagttaataaatagtgtcagaatatacaaaggtaaattattagaagtaaaaggagatatataaaaattcaaaattgtagtgagagatttccatacatatacttattaactgatggaccaggcagaaaaaaacaatcagtaaagagataaaagaccaaaaaaaaaaaaaaagattgcaaacttgatctagttgaaatattcaaaacattactactgtataataatattcttcccaaatgcataatttaccaaaattaaacattatctatctatctatctatctatctgtctacctacctacctacctacctagtttcaaaggtttggaaatgtgaagtatattttccaacctaaatggagttaacctagaaatgggtaagaaaaataagtagaaaatatcatggacttggaacatagactatttttcaataattcatgagcaagagaagaaattacaagagaaatttaaaaatagtttgaaataataatgataatgtaacatctcaatacttgtaaggttcaggtaaagtcatgcttagaaagaaatttatatttaatatatacatgagacaaaggctgaaaaatcaacgattaagcactaaactcaaaaaatcaacaaagagcaaattaaatgcaaataaagtgaaaactagaaaacaataaaaaataagagtggaaatcaatataactgaagcaaacacataatagaagaataactaagaaaaaaggtggttctttgaaaaggctaatatagttgatgataacttgtcaataccctgatcataaaaaaggcagaaaaaaatccataatgaacaatgagattattacagctcacataggcattaaaaaggtaatagaatattttgaatagctgtatgccaatgcatttgaaaattgacataaaatgaacaaatttctgaaaaaacacaagctaactaaactgacacaagaaaacgtatcatttctaaaaatatgaatatttctatatttgtgaaagaaaatacatttataattttaaaacttttcataggaaaatctataacctcagtgttgttactggtaaattttaccaaacacatttggaaaaacaaaataccaatcttacgttaagttctttcaggaaacagaaaaaacgtggaacattttccagctgtttttttgaggttaccataatcttcatatcaaacctgacaaggactttacaagaaaaatcaaacaccaatcattgtcataaacccgtatgcaaaaatattacaaatttgtgctaaccaaatccattaatatagaaaaaagataatatacaaccaaacagcctagttcggtttattccaagaatggaaaattggcataacatgtaaaatcagttaatgtaattcaccatatgaagagaataaaaggaaacaatcatctcaagaaatgtaaaaaaaagaagtcatctgattatttatctgatttatttataataaaagcccttagcaaacaaagaataaaaaaaaaagactttattggccggtctcacgcctgtaatcccagcacttcgggaggccgaggcgggcggatcatgaagtcaagagatcaagaccatcccagccaacatggtgaaacctcatctgtactaaaaaaaatacaaaaattagctgggtgtggtggcatgcctatagtctcagctgcttgggaggctgaggttgcactgagctgagattgcgccactgcactccagcctggtgacagagtgagactgtctcaaaaaaaaaaggactttatttatttagtaaacagtatctagaaataacttccagcaaacattatacagaatggtaaaatattaaaaatttttcctctaaaatcaagaacaaagtaaaaaatgccagtgttacttacatttgacatgtacaagaggtcctagtcaatgcaataaggcaagaaaaagccaaaacatgtgaggattttaatggaatgaatgacagaagtctagtcctcttccctttcaaaataagctgtggcttccagaaaaaaaaaaaaaagagaaaggatgatgggaatgaaaacaacagcagatatctactatgtttctctagatgaaaataaatatagttactctgtttttagctgacaactagtcagtgtcaggatattgatgaacctcagtccgtcaatcagaaaaactactgctatcatcacacagaaggggttagaattcaagctgtactgcctgctagctgtaggacctttgacaggtcatatagcatgtctagcatttagatccttcatctgcaaaatgtgggtggcagaagtacttgcttcctctgcctgtatgaagattaaataaaattatacaatgtaataaccctaacatataaatacaaaataaacgttagatgaattttactgaaattattagtaacaactccaaagccttggttccttcagttaaggcgaccactgaagttaatctcatgtgaaaataaattataccccaaatttaacacaaacaactataacaggtgatctggaactgaaaataataacaaaaaattaatgaagcttacattaatgagatatttaaatattaccttacttttttcaaaaagtgttccttttctctctctttcccatgatttttttaaaaaaagcttttaattgctgcaaaccggcagaaaaatacttatttatatcttaaaggtactgctcaatgaattttcacaaactaaacacgtccatgtaaccaacacccagatcaaattcttcccatgatttgatcattcagaaaatctttgacaaagaggttgacaaactcaagctggagtcagacaacccagatgctaattctggctctaatagggatgcactggttgacttaaattagctccttccctacatcctttgcatcctaatttttctcatgtggaaactaagagcaacacattcccctgcccctccaacctcttgtttcacagtggagttccaggaccataactgcaggcaaccaaaaccgtcttcctaaagctccctctcctttagcttccatgagtctagaccttcctgaatttcatccactgcccccggattattgcttagtttagtttctgttcatctttgaatgaagacatttcccaagattctgttctgcccccaactctcctcagtttctcattaaatttctcactgcactttctcattcaattcctggttagtttcatctgatcacctccatgtccagacttccaagtgcaaaatccaaccctaatttttctccccaactccagtccaagattttcaactacctgctgatatcttcaagtcctgttgatacatcagtcccaatctatcaaaagagaaatcatctttcctccccataccttctccctatgttatattctttactttgattaccacttctggtcacctctgtaagacacctgggaatcatcagctttctctggttcacttgccaaatcttgttaattctaccaccccaatatcctttgaaatgtccctttgtcactatgcctaccccacttctctaattcagttcatctgcctgagggatttcaagagtttcctgactgatctgctactcatggatctaatttctgcaatgcatctttcattctctaatggacttcttttcctaaaggtgtgtcagatcatgaaaatttcctgcctttagtcatcctacataaaagcagaataaagaacaaactccttggcctgtcaacctaaaaggacggttcctttccagaaccatccaccatgaaatagcatcatacaaattacactggagcctcaccagagtgtgcactgttcctgcatttccataaacccatgattttctaactttttgcctcttctgtactcaccaaagtgatatgtatccttaaatttcttccctggccttcacaatcagaataaattagcccttcatttcagaaccaacaccacttttttttaatacatatataagaacttaaaaataaaactacttttgtctactttgtgtcaagcatttgaataggtactttatatgctataattcatttaatcctcattagttgaatcttcacagcaactttacattttagagatgagaaacttggtctaattaaggctgaatggttcacccgaggtcttactaaagtgaagtaaacgtaggagccaggatcagaatccaagactttgggattccaaagtcaattttctttatacttcgcaaaataatttctacagctaattgtttatatgtgtctccctaaaagactgcaagctctcagctgagaatgtgaataatctatttcagcccactacctcaaccctgcaaacacacagacacacacagacacacacacacacacacacacacacacacacacacagagacaccctaattgggttacttccacaacagtttgactctgtaactgttgaggaggtgaatgaataaattatcaaggttcttacattaatacctactcagatcttatgatagatattaatgacaaaagaggtatttctgtacctgtctctgtggaacttgcaaacacagaaaagaacaataacaaaataacatcagttgtagcatttactagtccagaaatagctcacctatgaaacaaacacaattttaattcattttccccatcccctaataggaaaatagttctttctgtgggggccaagggaaaacttccctgtcacactctgaaggttcactgaaaatcactgacaaaaggcagattaacaagagaaaaggcatacaaattcatttggtcatagttttgcatgacacgggagccttcagaatgaagagccaaagagacaggagaaattgtccatttttatgcttagattcaacaaaggatgaacagctgtgttgaaacacgattgggcaaaaagggaatgatctaatggtaacagactgagtggggaagctcagcaacgcctgtctgtttagatttctgggcctctctgaagctttccttccttctgggtatgaggcaggcccctctctggaatgcaggtgttatgacctacagtcaaacaagtcagataagttctttacggctagtttttatacagaagtggggaggagtgtagggggcagttagagtagtatttttaggttttatggctggctttaggggaaaggggttctggcttctatgacccgccttcaggaaggggaattctagtttctatgcctaaccttgggggagagtaagaggccagagacaggagggaacgaggtcagagaaacatgcttctgagtccctcatattgggatatcattttctgagctttaacatttctgtaagaataatgacaactaatttgaggtgcagcactaaaaatagaaggaatctagcagctcttgaggggtccatcctgagttgctttgttctgatcacttagcatgtgatcttgctacctagaaaattattttacctgtggtttttctcattgaaacccaggccataaattccatcctgcactaccttccttccactcgatcacatttgcattttttggctgccacgagacttaccttgagttctgcttctttttttatttttatttttgagatggagtctcgctctgtcaccaggctggagtgcagcagcgtgatctcggctcactgcaacttccacctcccaggttcaagcgattctcctgtctcagcctcccaagtagctgggactacaggtgcccaccaccatgcctggctaatttttgtatttttagtagagacgggtttcactgtgttggtcaggatggtctcgatctcctgaccttgtgatctgcccacctcgggctcccaaagtgctgggattacaggtgtgagccaccgtgcccggcctgagttctgcttctttccaagatagatcctctggttttctgttgattctgtgagcaccaggtactccaaagaatatcatttcaacaaacagttttctgtttaaaccaatcaaagtaagatcctatggcttgaaattaagaatcttgcctgacataatccctgtctcttgataaacacaaacaggcaatcaccaaaccagtgccataactccacaactcaatttttaaaaattaaaatataataaatcccctctcttttcatttattcgttcgttcatggcaggtacatttctagataatgaagatacagttataaattttgatggattttacaattttcatatctttgttattggcaaccaaagggtataacatgcacagtccagacaaggaagttaatcagaaacagtaaaaacttatcttcccgaaatgataacctgaaggtcaaatacaacaggagctactcttgccctttcaaatggccaacaatctgaagatatcaactaaatgccaaatattaccaaaagtaaatactataggagttgcccagtttgttaggtgagagtttaaaggaaactttagaaagaatgagcctgaaatgatgggaggaacacaggtgtgtatagagaaggagggatggaaccatttatggtgaaattttctcagaaatggcacaaagaaaggagctcaagaatcacagtcaacacccaaggaggagggtaattcattggattgaaaggatcccagaggaataaaaagttgtagaagaaaagaccaaactattgcatttgctcaccaagttctagagaattattttatcctctaggtcacagagatgggctgcagggggtggatagataagatgtggtgtgcaagttcttaaaatatgtactgcatatcatacattttaggtgggtattggacaattttcttagtgaataaagaggaaattcatttagcaaaaatcaaaattaaggtaactctagcattctttttcctttctctctgaaaaggtaataattgtgatatctgccaatttataatagaaatgtttaaaaacaaaagaattaaacttagagagttctccttaaaagtcagacaaatttatcaacaaaagagaagaaaccattgtctcaagtgtctttttgttgtttctttattcttcttattttctgcaaaaaaaaaaaagaatgagcctatgaaaagcaatgttaatgatggcacactctggggttttcactaatgttttaaataggctttacatagagcagcaattatgtgagatgatatagttaaacagtatcgataataaaatattccatttgagcacctcaaaatactttggactaattcatattagaacatcttgctatcagaactgttgagtttaaaataatatacacatatgtatatgtatactcatatattatataaacacagttacacaaaagtaaatttatttattaatagattcatccctttttatctatggtcataaaattcaaggatcagtaatagaatccatagatcccctaaattcatttgtgatttttttttttttttttttgagatggagtctcactctgtcaacaggctagagtgcagtggcaccatcctggctcactgcaacctctgcctcctgggttcaagcgattctcctgcctcagcctccagagtagctggaattacaccactatgcacaccacgcccagctaattttttttttttttttcagtagagacggggtttcaccatgttggccaggatggtctcgatctcttgacctcatgatccacccgcctcggcctcccaaagtgctgggattacaggcatgagccactgtaaccgactgcatttgtcatcattttttaacatctttcttattcataaaccaattagctagtgggaaaaaattaattagcatttgtaggatatactttttttttttttgagacagagtcttgttctgttgtctaggctggagtgcactgacacgaccttggctcacttcagcctccaccccccaggttcaagtgattctcctacctcagcctcctgaactacaggcatgcaaccaccacacccagctaatttttgtatttttgtatttttagtagagacagagtttcaccatcttgcccagtccagtctcgaactctagacctcaggtgatccacccacctcagcctcccaaagtgttgggattacaggcgtgagccactgcacctggccaggatatactatcttgattttttcctaatcttaactttaaagatgctcctatgaataatactaataaggtcccaggtaatgagagagaacaaagggtaaagagtcttggtaattcccaggctagacaaatattaatagacctatggagaggtacaagacagctgacttgttagaactgtgcagtttgttactgaagccaaaaatttggcagtaatttctagacagtaatttcgtaagtgttttttttttttacatttatgcccccatgtttaacccactagcaaattcagttgactcagcccccaaaacacacctgagataatctatttctaggcatccccattataatcaccctggtcccatggaccattatttctggcctgaactaatgcaacagcttcttaattggttttgctgttgccattcttacccagttacgatccatttgccccatgacttaaagaatgaactttttttttttttttttgagacagagtttcgctctgtcaccaggctggggtgcagtggcgctcggctcactgcagcctccccttcctgggttcaagctattctcctccctccgtctcctgagtagctgggattacaggtgcccaccaccacacctggttaatttttgtatttttagtaaagatggggtttcaccatgttggccaggatggtatcaatctcttgacctcgtgatctgcccacctcagcctcccaaagaatgaacttttaaatacttaaccagatggcttcattcttcttttaaaagtttctcattgggttcacattgctatcagtaaattaggaacttcttactttggcatacaacgtgagaagatggaactgccatctatgtgcccaatcttattctttgtcacggtctttttcatgtaccatactcccagctgcccttcctcagttcctcaaacacaccaatcccatttcctccttacggcattgggactagctctcacatgatttgaaactctcttcctgctcacctctccatgttaaccctaacttaaatgtcacccccttaggccatgggaacacccaatttaacctaattcttcagccacattacatggctcacctttaattctctccatagcacttagtgctgtctcaatttaccttctttctttctccctccctccctctctctctccttttcttccttctttctctctctggttttttttttttttttttttttttttgagatggagtctcgctctgttgcccaggctggagtgcagtggtgcgatctgggctccctgcaagctccgcctcccgggttcacgccattctcctgcctcagcctcccgagtagctgggactacaggtgcccaccaccacgcccggctaatttttgtatttttagtagagacggggtttcaccgtgttagccaggttggtctcaatctcccgacctcgtgatctgcccgcctcggcctcccaaagtctctttgtttctttctttctctctctctctttctttcccctttcccttctaaagatcaagaattatgcatgctttgttcatcactgtgccaggtatggagtatgcactttaaaatgcatatatatatatgcgtaaatatacagctatgtacatatagtttacattttgatatcatgcagaccgatagctatgaaatctgattattcattcagtgaaggtttactaaacacctatatattccaggcactggaatatgagacagacaagactactgtcttcatgcagcccacatttagctcagggagacagagaactaacaaacaaatgaacaaacaaaagaaaatttcaggctgtaataactgctaggaataaaattaaaaaggtaatatcaaagaaagttataatggacttgttcaaaaagcttcattaaccaaacgcaccaaaagaatcaattgaaatgttcaagtagaagacattttgcaatttttaaatatcttattctccaaaatcttccacacgtttggaagcagttgtccataaactaccttcgaatgaaacatccactaaattactgccactagaaaaagaaaagactggctcaatgctcaagattaaaatgcaggctgacactttctgctttacttgttttggggttgtgtggagaaatgctgacatctttgccttttttctttgagatggaatctccctctgtcacccaggctggagtgcaatggtacgatctccgctcactgcaacctctgctgcccaggttcaagcgattctccttcctcagcctcctgaatagctgggaatacaggcgcccgccactgtgcctggctaatttttgtagttttagtagagatgggagtttcaccatcctggccaggtggtcttgaactcctgaccttgtgatccacctgcctcatcctcccaaagtgctgggattacaggcgtgagccaccgcgcctggaccatctttgccttttttgaaaatagaaagagtagtaattcttgcattgagaatatgacataatcccaaccccaaaccatgagtctcatggccatgtctaagccacgccctgacgatagggttgggatgactacgccaggcttagtaatgcacagggacaggaggcatttcggaaccacaccacgacactgctggcaagaaagatgggaaaacggcagcaattctgtctgctgtgctttgtgtgtgtgttctacctggctgattgaatttcctcccaacacctacctcagatgtgttgtctaggtgaaaataagcacttcaatgagctggtctaattttaatcctcagcccttcccagtcagccccgcccccatgtagttacctccgtcatgacaaagaggaacatcccaggtgcaaatctagcacagtttccctatttcacctgtgtccccctccccatcttcatgccagcatcagaaacaagagtccaaacatcctcggcaacactacagaagctgttcaaacaatccctgtgttctttccaatttgccgacgtggtctggcaaacaaagagatttctttgtttctctaagaaacaaaggtttcgtaagagaaaccttaagagatgataaatacaattaatagagagatagccaggcaaggtaagagaatgcttgactgttttaactgcttatcctgtgctgtaacagcttacctaagagatgtcagagggacggacagaaacctatcagcgctcaggcagaacaggtgctccagtggaggcaaggactgcgcctgcatctgtccatgcagaaactatgttctcatggatacaggctgatgatagtaaattctggtgggctatttactggtggagtgtctgttcccaaagaaaattaattattaaatcagtgtcaacttagagagatgtctctagtggtctgccgcagggcactgtctggggcactgtctgaggcactgtccactctgccacttttaacagtgctttgatggcctggggcacacagatgacacacttatctatgtgtgataacgctcagcctagaggaacacagaatgtattgaataaagggatctgattcagataagtgggcataatggaaatttagcaaggtgatatttaacaaaccgcgagcttaccttaaaaataaaaatgaaatccccatgagaatggatggggagaatgtaataaacattagtacaaataagacttaggagttttaatttaccattaataatagtaattgtaataatgataatagtaggtagcacttatcaagagtttatcatgtaccaagcactgttctaataatttaaaacttatcattagaggctgggcatggtggctcacatctgtaatcccagcactttgggaggctgaggcaggaggatcacttgaacccaggagtttgagaccagcctgggcaacatagcaaaaccatgtaagtatgaaaaattttaaaaattagctgggcagcctggcatgcacctgtagtcccagctactcaggaggctgaggtgggaggattgcttgagcctgggagactgaggctgcagtgagctgtgttcatgccactgcactgcagcgtgggtgtcagagccagaccctgtctccaaaatataaaataataaaataaagaaaattaaaataaaatatattattaactcatttaatcttgacagaatctttagagtaccttattggtatctccattctataggtgaagaacagatgtaaagtaacttaaaatgaatcaataatgtaatgtcattgtcaaaaagtattaatgtgatcttagagaatagggtccagaacatgagaattgataaagcttctctaactgcacttaaattattgtattctgttttgggcaaaatggagccttgaggaaaaaggttagcatgaccaggaatgcaaccatatatatatatattttttctttttgagatggagtctcgccctgttgcccaggctggagtgcagtggtgctatcttggttcactgcaacctctgcctgccaggttcaagtgattctcctgcctcagtctcctgactagctgggcttacaggcttataccactatgccccggtaatttttgtatttttagtagagatggggtttcaccaagttggccaggctggtctcaaactccggacctcgtgatccacccacctcggcctcccaaagtgctgggattacaggcgtgagccaccacgcccggctccaggaatgcaaccatttttaaagaggaacaatgaatagaaaagtctgatggatttatggctaaataacagaaagaagggtagaacatgagagtttgagtgaggacttcaaacccttcgtaaagttcagtttaaatagcatgaaacatatgccctgctgctttggagtgtggccatgaaaataatagcaaacacattccatggaatatttactatgactttcccagattacaaagtacaaggattagatgtggaaaagaataaatagaagctcaataaaaagcaaagctttctagtgggattgctttgtgagatgggaatcatgcctcactgaggatgtgcaggcagtggctgaaatcagatgacacagggcgaagggacctccccggatctctactctgtgagtctataaagaataaactgcagacactattttggtaatagatcaacataagaaaatttaaggctagaggtcaattgtggtaaccaaactaaatgtcctctgaaaaggcctccacctgtacttctaagtgtttccataaaatttagtaaatattggccaggtgtggggctcatgcctgtaatcccagcactttgggaggacgagaaggatggatcacctgaggtggggagttcaaaaccagcctggccaacatggtaaaaccccatctctactaaaaatacaaaaattagctgggtgtggtggcgcttgcctgtaatcccagctactcgggaggctgagtcaggagaatcacttgaacccgggagggggaggttgcagtgagctgagatggcgccattgcactccagaccctgtgtgtttattcactaggctatcccctgcccacccagactccatcatgaaatgaaaggcaggcatagcacaatattagtcagataagagtctcatattatgtgggaaccatgccattttatttctgaaacagcaacttcattgtgaggcttagaaatccctgagctttgtggcaactgaagacctgtcaccgtcaccgtagctggagtagtgagcaacacgaggtggtgggacaaaagccattcctttaagtgtcctctgtacctgacaaaagaggacatcaccaaagacctagcatacagttggtactcataaaggttggctgaattgaggctaattttctagctgcagcaccagtcctgtttataaaaaccggtcaaatcaatcttctacaaggaattgaacttcgagcactttgaagtttctaaatggaagtctgtatgtttcatcaagcttaaaaaacagtccaaggcattgatgtagcaaggcgttatggtgtcatagaaaggaaactggacaaagagttaaaacaaaaacggatttgaatcatggtctgtctcgatgcctcagtttcctaatgtggaaaacaattttatttttcacaagattctaaaaatccaatataattgcgttaggtgaaaagcattctgtgtacggtgacaagttatacaagtataaataatcaatatcattactaacaattacattattattaattgaatgagtgtattcacccattaatcattaccaatccattattacatgtgtattattaatgattattattcaattattatatgtattcatttattatacatgtaataattgagtaataaattattcaattataattaataaataatagttaattattacatgtgtaataattgaatacatgtactaattgagtaataataacaaatacacatgtaataactggatacactgaaggaagtgtattcacttatggtttataaacattccaacatcagatatgtaatatttgcctctttgtcatttagaataatctgtatcactagtcaagtgtttgtatccaaaacccaggaacagggtcgacttcgtgggtgtgtcacctgagaggtgacacacggttccaagcttaaagggccttgtgcttggtttaatgctctgctgtttccatcctgaaattcttattagcgtatgcatttttattttgtgctggacctcataaattatgtagccagtcctgtggtgtgaataaaagctgaatctgaagctgccagggtaggagagttggaggaaaaggtgggcttacaggaggaagctcctagctgtctgcacaggagggtagtactcagttgcatctgactgcagcactgaataagaatctcagggaccttggatatcattcagacccatctctcatttcaattgaagaaatcaagagtcccagattttcggccatttgcccgaggtgcccacctcaccagcagggtgtcctctacattctgtctaatgaatgaatggcctgccctggaacataagtagggcttccgcgttgttgtaggacagctttgtgttccagatcacagatgtctctttcataagccacacctcctcccactgctgtgtgggccacagctccggttagatgataactctttgactttttctcaaagtccctgaaatcagtcacagagaaaatggactgatcctttacatcaatctgagtgtccttgtgcgtgtgtttcattttgctttctattcatcctcaatgattgccaacctgcttgtgagatgtacctgagaataaccttcagacaaacgcagtgggctctgcattgatggtgctgattcagaacacatttggggtgttgtgtcatctgtctattagaatgcttccaaaggatgacgactcactgatagataatgttttgtttacaagcatgtccttgggtatgagactttgtagtgtcatgactgaccgtaaatctcactggcagtagcacagcatatgaaacaccttctgctctagtcattactttatgttcatcacaaacaaatcagaacaaattctgaatgcgaatctcctttcaagttagctgactcaggctgtcggaactcatgtaaaagcgaaccaaatatgacaggaggtgaaagctggccgtagaactggaaacggcagaacgtcattgaagtctgcctaagaactagtcagcatcccacctgcttgctcacagtcacactcaacatctctgtggaatttttagtgctcttttttgtattagtcttttagtcgttaccctagtgactctgatatgcattcctaacttatcagtttactttgaattaacattagaccacttgatatataatgtaagaacttcttacagtgtaatttcatgtacagacttcacaatccttttgttgtagctaaagtttacttctacctagattataaactccacaatactttgtcattaatgtactttatcaggtatgaagattcagttaattttaaataattttttaaaaagaaaaatactctttttcactctgatgcccaggctggagtgtagcagtgcaatcactgctcactgcagctttgacttcccaagcttaagcgatcctcccacctcagcctcccaattagctgggactacaggtgtgtgccaccatgcctgggtaattttttctacttttagtaaagacagggtctcactatgttgctcaggctggtctcaaactcctggactcaagtaatcctccccccgggcctcccaaagtgctggaattacaggcacgagccaccatgcccagcaagaaaaatagcctttatatttatctatgtattaacaatgtcttttacttgcctctccagtagatctaattttctatctggtatcatttcctttcagcctgaagaccccctccttgagcatttctcatgttatagacctgtcagcaacaaattctctcggtttttatttatcttaattttttttattatgccttcattttaaaaacattattttctttaatatagaattctagactgacaaggtattttcagccctagaaacttatcattccatgttgcctggtctcaattatccaatgacatgtcaattgtataagctagtttaaacaattcttgtcatttttattcaatatataatgttttttttttctttggctgacttttaaatttttctttcaacctttggacttcagcagatctgcttaaggtgtggttttctttattgactgagattcttgaatctgtgggcgactgttttaggccaaatttggaaaattttcagccagaatttcttcaactatttttttcttcttcattttctctcttctcttcatcaaggactacagataaaagtatatcagatcactctatactgtccctcagatcattgagaatgtgttcattcttaaaatctttttttaaatttgtgactcattttaggtaatttctattgattcgtgaccaaataaactgcttcttttgttgtgtctggtctgctgttaatctcatccagtacgttttttaaagcttcatctattatatatttcagttcttagatttacatttgctttatttttaaatttttcttatttttcttgaagttccccaattctttatcctaactatggatactataactttaaccattatatctattttttcctatggattctttatgtgcttatcatagttaatttagagtacttgtctgctaactccaatatcagaaatatttctgtaaaattattttttcttgactatgtctaataatttttagagtgccctggtcaaaataacttttgattgtatagtggcactgtggatgattcattgtaaaattttagaatccattatctctctttgaagagtattgagtcttgtactagcaggcaattaaattactaatgaatcaccctgactatgctgagacttgatgtgtttcatgaggatatgtctattttagttatgccatctctcagtcttgatacatggtatttattactaggagtggcccttataggttttcagtgaaaagttcaacatagttatcaatgccctctaacttcacgggactcatacttcaaacgctggctcttagcaacaggaagtagttgaaatctctgttaggctctttcagccttctgactgttggtttcctctagggctccttgactatttcccgaataaatgagcaggtcaggagtcaaccaaggacttgagaggagtttacgttcatattgtgcaacccctccttctatgtctctctcttttctagtatttcctcccccagtttccagctgctctggctgttctaaacttcctttctgactcctcaggcaaataggacttcaaaaattttttttggcctcagttctagccacccaagagatattattcgggaagtcctcgtaggggaaaaaaacagtgtgtatcttaaccaatgtcattcccttgtttgaagcgttaaatgccctctaattccatctgcatttggttgctttcattaacttgaaaattctctttctatttttccccagagtttataattgctatcagtagaaggcttaatcttatacaagcacttctaccatctccaagaccagagtgctccattggtttaatgtgtaaccatgagtgaacaaaattgttttcaaaaaatagacaaacctcactgaacctcaatgaacactgaaaagtaagaataaaggccgggcgcggtggctcacgcctgtcatcccagcactttgggaggccgaggcaggaagatcacgaggttaggagatcgagaccatcctggccaatatggtgaaaccccatctctattaaaatataaaaaaacgtagccgggcgtggtggcatgtgcctgtcatcccagctacctgggaggctgaggcaggggaacaggctgaacctgggaggtagaggttgtagtgagccgagatggtgccactgcactccagcctgggtgacaaagcgagaccctgtctcagaaaaaaataaataaataaaataaaaataaaaaaaggaagaaaaatgagaataaaaagaggtaaaacatggcgtttcatcttataaatttaaaatatacctgatttggtactgaatgattgtaactaagtttttaaacagtgttcatggcgtgactgtaaacccagctcacttttagaaaaacgtttttaccaacccaaacagtatcctactcaacaccagttatatttgtgggaagagagatagagttttctggggaaaggcccactcttctaagaaaatatatggttttctttgcattacttttccttctttattccctattcacgctattgaacatgtctatcccaacccttttttctggtcacataatccaggtctgaccacttggccttcttcttctcaatgtaattgatttaggaatgagtttgtggcccaaacaaatggaaagagatataatcctgggaatctgaatgaaataattggtaagataaagttttcttttcactgaggtagacagtagaatataaacttggaactggtatggccatcttgtcatctcttgaagacagcctgcctaagaatgaaaatcaatgctgagaaatataggacagagtcctgacaatgtcagttaaacctgaatccagcaactctgatagctatccctgattgcttagttatttgagccatttcattattgttaattgcccttacagcattttcagctgagttggtgttgtagaatgaacatttgtgtcctaccacaaattcatatgttgaagttctaacctccagtgtggctgtatttggacacagggcctttagggaagtaatggaggttaaatgaggtcataggggtggggccctgatccaataggattggtgtccttataggaagagccactgagcttgctttctctctccaggtgcacatattgaggaaaggccatgtgaggatatagtgagcaggccacctgctatgagccaggaagggaccccctcaccagaaacagaattttctggctccttgattatggacttctaggtttcagaactgtgagaaaataaatgtctgttgttgaagctacccaacctgtggtttttgctgtggcagctgagcagactaattcagttggggtcacttaaaactatgagtctccagtcatccaggaagtaggggtgcaaaggcagatttgtactgtgaccctgtcatggcaattcattctactggcaaaaatttccctcaattaaaacccaaatgatttcaaaacaccccataataggatcagcaagagactccaccaagactgaaaatccactgtgccaacaaaagccttctaaatgcacgttttagactttccttttaccttttcaagtggctcactggcaaaaatcaaggttctaattaaatctaaagggctatccaatcacacggttggcaccaattactcatttaactatgtatgtgttaagcataagctaattgcctttctctcaaaccagagccagttcagatcaggccattcaagagcatttaaacttggcacaagagggtagcactgaaaactgacaataaagaattctctcttgcaggagaacctttcaggaggctttcaatcaatttttgcaagttccaaaactcaaagaagcaaagctaactatgtagctggtgtatttctttctagatcttgaagcattaataaaaagatggactcatctgagaatcaaatatctggtgaaactatacataaatagatatatttgtgtgtctgtgttcatgtgtgtgcatgtggatatgtgtgtgtgtgtataattgcatgatgttcttcctcaccttcaaattctgacagattctaaggaggaagggcacagatgtgtttcctgcaaaagagccccgagtatcttttttcacctcccttccttccctttgtccagatgagaatctttgttttaggggaaatggaatttaatatgtaaaatttattctcagtgagtttcaccaaaataggaaccatatctctaaccttatattattattatctgtacaatacctgtcaaacggagcccccagtaaatgctgaaagcacttcacatccattgggaaggtgagtgcatttccctaacgtattttagagtataattaacacacagtgcctaacagagaaaatcatttttgtgtgttcagctaaacactcaactccacataagttgcatttgatatcgggttcactcggagaaatggctctcacacttgagcctgtgtcagaatcacctagaggggctgttgaaacagactgctgctctgggtcctttccccttcccctgggtttctgactccttagacttaagtgggggggtcccagaattacaatttttgtttgtttgttttttgagacggagtctcacactgtcacccaggctggagtgcaatggcgcaatctcggctcaccgcaacctccacctcccaggttcacgtgattctcctgtctcagtctcccgagtagctgggattacaggcacacaccaccacacctggctaattttttttttgtatttttagtagagatggggtttcactatgctggcaagactggtcttgaactcccataattagaatgtttaacaagttttctggggatgctgctgctgctggactggggaaccacactttgagaaccattggctaagaagctataggacaagagaggcagcttgccagcaggaaaggcattaagtgctctgctttctgggggagttttgcagtagttcacccactgtcaggagctacaaggctcacatccagctggtgtgagggcatcatgacttaaaagctacatgcctcacatctcttgtaataacttcatagacatagtgatgcggtttggctgtgtccccacccaaatctcatcttggatttccacatgttgtgggagggactcagtgggaggtaactgaatcatgagggcaagtttttcccatgctgttcctgtggtagtgaataagtctcattagatctgatggttttaaaaagaggagtttccctgcacgagctctctctctttgcctgctgccatccatataagacgtgacgtgatcctccttgccttctgccatgattgtgaggatttcccagtcacatggaactgtaagtccaattaaacctctttcttttgtaaattgcccagcctcaggtgtgtctttatcagcagcatgaaaacagacgaatacacagagcttgcagggaccccactagagatgtgccagttacccgagtcacagtctgagatggtcagagttatggcttcctttcaggtatttacaggtcacccagtacaggaatgacacccattagtaccaatcagggatcactttacaatgttgcctagtgacaaagttgaaacataccacctttgtatgtttgcagagaaacagagctagaaagataagatcaaattttcatgcagaaggggaaagaaagcattcctttgttaagcctttattcacaaggtacatatctttactcacattatgcccctattttaaaagcttaagaaatgtaaacattatgtcaaaaatttttcattcttggtttagctgaatctcaaagccaccagttggaaggatcatgccaatcaaggaagcagatggcttgctttgggcttcttcaacaaaatcacctagatcctaaattgctgtttctgtgacaatccatattgtctgtttctgttgcacatgataccacaggatttgctaatctctaacctaatttgtaaataggaagtaaatttctacttcagagcttctatcatctagtttttcttcacctgactgctatatggtctgcttcattttgttatgttgcttacttgaaaagaccatggagaaaatgtatttgttatttaaataaatacccaaatttgcaactccagatcttaactctgctaataaaagaaacttttaaaagaaacaatcttggcctaagtaaggaattcttacccttgttacataaacctagagatctaaagaagtaattattagccctggttgcattcacttaaagatctttttaaaaatactgacgcctgaaccatactgcaggccaattaaatcacaatgtctagagagatagggtccaggcacagaatgttcttaaagctccccagataattctaatgtagagccagcgttaagaacttttgaaactaaagtctatcactgagagaaaattatttttccttcctgtcacccttcctccccttctccttttttttaagaaagaaaatactgggaaagaaatcctaggctgtaattatgtgggttggttacagctttctttacaaacactcctgggttatcagaagaactgctctaaccttggggcaggtggactcttcctataatgacatgtaattattagtattattaatacttttgcaatcatattaataattaaggttcttttgcaataaaaaagagacatgggccaggcaggttggctcatgcctataatcccagcactttgggaggctgatgcaggaagactggcttgagctaagaagtttgaggccgcagtgagctatgtttgcaccactgcactccagcctgggtgacagacagagagagagagatgaaaggaagaaaggaaaggaagaaaggaagaaaggaaggaaggaagaagcaaggaaggaaggaaggaaggaaggaaggaaggaaggaaggaaggaagagagagagaaaggaaggaaggaaggaaggaaggaaggaaggaaaagaaagaaagaaagaaagagagagagagagaaaggaaggaaggaaggaagaaaggaaggaaggaaggaaggaagggagggaaagaaagaaagaaagaaaagaaaaaagaaaacaaaagaaggaaggaaggggaaaaaagaaagagagaaagaaagagaaagaaagaaaaagagacatgaatctaagctaaaaaattagacaaagattaggttctgcacttcagtttaaaaaagaagaaataagtacgcaaatctatcatttaatgagagcaaatatttatgtctccatgtcttaaaaatgcagatgtggcatagactggcgagatgctcacccacctgtttcctttcttcctgagcatgtgcctgaacatttcccagcttcctttgtccatggatatagtgacgtgactgagaatagtcagtggaatacgggcagatgtaaatatcacatccagagctggtcaatgaagcctacccatacatgactgtgatagttacttttatgtgtcagcttggctgggcgacaacgcccagataagtagttaaacattattctggacgtttctgtgaaggtacttttgaatgagattaacattcacatcagtgggctttgaataaaacagattgcctacaagaatgtgcctcatccaatcagttaaaggcctgtatataacaaaagactgaccacccccaactgaaaaaagaattctgtaggagatggccttcgaacttgaatggaaacatctactcttctctgggtttccaaagttctggcctattctataaattatagacttgctagcctccataaacataagccaattccttaaaataaatctttctttcctttctctctctctctctctttatacacacacacatacattttatactcacacatatacactttatacacacacacatagacatacccgtattctattggttctgtttttctggagaaccctgactaatacaatgaatttctaggaagaactcttaagaatgaagaaagaatttgggtttctttgttggaagtcctcttgccaaccagggacatccacatggacttagcatgaatgggaaataaactttcattgtgttaagctactgaaatttgtggttgtgattgttatagctgccagcattacttgatctaactaatatagcagatggtgaatgagatggttgttaatttccctttatcgctgacattctaaagcagtggttctcaaactcagctgtgcataaaaaaatcttaaagctttgagaaagtactcatacttggtctttaccccgaaattacgatttctttggtttctgaggtatagcccaggcactggaatttctaaattctctccaggtgattctaatatgtcaataatttgaagaactactgttatacaggatgactgagaccagagttaaaagttcatggataagagaaaccaagagggttctgttggtgaaaggcttcatctggatgaatggtatgattttctggcctcaaagcagagctcttgagctatataattatcgttattattaatagtaccaagaggatacatgcattatcttactaccttgctaaattctcacaataaaactcttccataaatattatgattctcacattttaaatgagagaagcaaagctcaaacagagattaaggtaacttgctcaaagtcacacagctaaggagtagagcccatgctcccaactctaacctgtaatacctcccattatcctaaagaaaatgctatcccacccccagccccccaccccctgacaggccctggtgtgtgatgttcccctccctatgtccatgtgttctcattgtttaactcccacttatgggtgagaacatgcagtgtttggttttctgttcttgcaatagtttgctgagaatgacggtttccagcttcattcatgtccctgcaaaggacatgaactcatcctttttgatggctgcatagtattccaaggtgtatatgtggcacattttctttatccagtctattattgatggacatttaaataacatatagtttcccaagccatttagcaggagaacctgctatagatcgagaaccactataattgagaaccactgctttagaatgtcaacgataaagggaaattaacaaccatctcattcaacgtctgctatgttagttacatcaagtaatgctggcagctataacagtcacaaccacaaatttcagtagcttaacacaatggaagtttatttcccattcatgctaaggccatgtggatgtccctggttggcaaatgtcctgatttgccaagatttgtcctgataaagaaaatgtcctgatcaaaataagtaagaatcacactgtgcaacttgctgctcagatacctgaaatattgcattcaattcccagagtcccagtttaaagaagaagatagtaaaattgtgttcagagaggagcaagtaggttgttggaaagcctggcaagcacgaataagtggaagagaaaggaagggttagatcccagaaaggcaatgctaaaaaagaaggaatgattaaagaaagagaacataatagcgcattcaaatattgtaaagtttgtcacgtgaaagaggaattagcctgttctccctttgtccagagggttaaatcaggatcataaattagacattgcaaaaaaaaaaaaagaaagaaaattctgtttggtataaagaagaccttctaataattagagcttttctgaaaactagcagggttgctaggatttaatgagaaaatatgttctgtaaatgcgtataaaacactgagtatttttgttgctattatcatgtaggtgagtgttccattcattgaaatgtgcaggtacatactgaaatggtggttctgcacaagataggaataagttagatggtcattaaggtccattctaatcctaagattttatcctcacatatcttgggtccctccaaaaaaaaaaaaaagtgttttataaaatgtcttgtctaatgactggttgactggtgaccaatatatatatatataccatatatatatttctttaatttattttttaattatactttaagttctggggtacatgtgcagaacatgcagttttgttacatagttatacacgtgccttggtggtttgctacacccatcaactcgtcacctacattaaataattctccaatgctatcccacctcccagccccccacccctcaacaggccctggtgtgtgatgttcccctccctatgtccacgtgttctcattgttcaactcccacttatgggtgagaacatgtagtgtttggttttctgttcttgtgatagtttgctgagaatgatggcttccagatgcatccatgtccctgcaaaggacatgaactcatcctttttgatggctgcatagtattccaaggtgtatatgtggtacattttctttatccagtctattattgatggacatttatataacatatattttcccaagccatttcgcaggatatgcagtctatttcttcccaccataaaagttaaagaaaatctacagcaataatttggtcaattgtggtttactgaaaacttactaggaggctaactttgagatattcactttacttgaatataaatatcacgaagtacatatagtggatagagtacttcctgagacagcacgaaggcccatgtctgtcccctttagctcctcccatagtcaatcattgtgttgagttgttcagtctgcattgtctcatcttctccatggcaagcttttctgaacaggtccactacgctttggtattctctccacagtatagctcagtgattgccacaccacagatgctcaacaaaagtttgatttggagatgacctagaccctacaaaagttgtctgtggtcctgcactcacagcatgataactgagggataatgtacaaggaaaaatgtgttttttttttcttttaaaaaaattttatataaatgtaagggatacaagtgtagttctgttacatggatatattgcctagtgatgaagcctgggctgtcagtatacccatctcccaaatagtggacattgtatccgttaagtaatttctcattcctcatcccccttgtaccctcccacttttccaagtctccaatgactattattccactctctgaatccatatgtacacattatttcactcccacttataagtgagaacatgtggtaagcaaaatacatgttagatatatctctgtaatgaaaggaaaagtaaaagaatcagtcttaaactactgaaataatttatgcatttctcccacatgtggcaaatatatcaactctctttaggtataatatacctgacctcattgctgatagcataagagctttaaacaaatacttattcaatacttagctttttctctcataaaatggaacaagatatactagggtagagaggacgcttctcacgttcactgctgtatcctcagcacttggtacatagtgtttgcatcacaaatactggctggatgaatcagtgaatgaatgaatgaatggggaggctatggatgtgaaatgtttgatatgccttttagagagatattacaggcctttgagtgactatgatatttccaccaagcttctcttttgagcatataacttagtaagtatcttaaagttcatgttgacagagagggtgaaagtatgaatactttcttgagcttggttatttctaacttgttaggtacagttatcaacagtgataacagtccagcctgagctagatataaacaagaactgtatgccagctttcaaattgcagtttccatgataagctggctctgttttgctgccactgaatagagtgccatttagcagtggtgagagtaagaaaaagttgatcctttggtactaaacagttgagacctactcaagggagctgacattttcaacaccacttgaaacttgggcttggagccaggagaaagtttacacacaatcaagagggcactgctgcatctgcaaaagcagtttcctgtagctagatcgtaaaccaagagtgatggagatgagagcacccaagttcataaaaattccctaatatgttcatttgtaaaagaagaaaacaacattggccaaagaaagatgttctcctagaaaaaggaaaagaaaaaaaggaaatccatcttaccctctaggtgaaaaacacaaataaaatgtccgcgggaatattaaatgcttttccaaaatgtgcaaaacaataagcttcctactgtcctggtgtgcaacgtttgagaggaggctggaagaaggagcattcttgtctatgggcacctgcttctgccatgctggagagaaggcaaatctcaaagggtctggtagttaggatgattggatagagtgatatctctatctcagtctaaaggattggaagtactacacattcttccttcatacagtccaccttttctgagcacctgttagcagccaggcagtgtagtaggaatgaggagataatcagttagccagaccacccctgcactcatggatcttatacaaaaacagaggtaaaagacaatcaacaatggactgattccattacaatgatggtgttagaagaagaaatagtactaggaatttacatagtggtgaaatctgacctacttcattccatgagcaggtgacaccgagctgaacattgatgcataagcagaaactgacaaaaggaagccattgccaccattgataggaataagaaataactatttcccaaattctttatgttatcaaattattctccacacaggtgttttggctttgcttttttaaattctgaagtctgaagtttcagaaactacattgtaattgaaaataggtactcccctctttttttctctgatgctttcattaaaaattctcatcatctttttatgttacttattcggaccttaaaatgtataaaaatatgtgtggtttttgctttcagaaggcacacttgggatctgaagcagcaataattatgaactgacaatacgaaggttggctggctctgatgaggaactccaaggaccttaaaattcacttatgtcaagaggggaaaaggaggaatctaccatagcaaaataagacccttgtacaggatacacccacgtgcacacgtgcactgagagaaaatgagagttgtagggggctgtaggatcctgactgtctcatgcctacagtgagaggttcatagagattaaagagattgctcaggttgtccagcttggaagtgacaaaggctgggagtgctgaatactggaatgtaatggaatccatctacaggtaaaaagcctatggcaacaattagagggagaggtaaagtctctgaggcggcaggcaattggtacggagcctgaaagcccaggacaaagttttatttgctttcaagagcgaataggctcacacctataatcctagcgctttgagaggctcagatgggaggatggtttgaattcagaagttcaaagccagcctgggacacacagtgagactctgtctctaccaaaaaaaaaaaaaaaaaaatagaacaattagctgggcatggtggtgtgcacctgtagtcctagaagctgagatgggaggtttgcttgagcccaggaggctgaggctgcagagagtgagccatgattgctccactacattacaccgtactcctaggtaacacagcaagaccttgtgtcacctccagaaaaaaagaaaaagccttaacaaacagaagtgaaggtaccctgagggaatattctatttggctggggactccttatcatgattttacttagtgttgcagcatattgtgttttctgaaggtaggtgttccccctcaatctttctcatcccaccggcccttctccaatgtgaccttgccattcctccatcaagaagggaactctaacttgcctccctcttcagatctaggctaccttatgagttgctggtagccaacaggaggtggtggtgaaagtgacactgagtgacttctcaggctatgccagaaaagccatggggcttgtgcttgattctcttgggacactggctctggggaagccactgaccatggaggtgactgactagcctgacgctgctattttgaaaaggccacatgttgatgctctagtcaatagagtatcaggtgagcccagcgttctgtccaccccggccacaatgccaaaacacgtgaatgaggaaatcattgtagaagtgatctcctcccagccatttacgtttccacctgagcccctagaaatcatggagctgaaataacatgccctgtctaaattgctaacacacagaaacggtacgcacaacaaaatcacataaatatagataaaatccactaggttaaaaggagtttgttacacataaaaaaaatgactgaaataaatgttatattatctatctataaagactactatgggcattgagcccgctgaacagataagaaacccaaggtacagagagataaacccaactagatgatagaatcataagtagaatcttataaatgcagcaataaaatgatcataaaagtacatgtgaggacactgagtttcatagaaaaatgacttggatccagatgcacagttaataaaggcagatccaggaaaagaacttagatttcctgaagagtgctggagtctgaagctctttccaaaatattagatcaagcacggggtagttaaaaaaaaaaatcacatgctttggcatcagatctgggctgattatatccctgaggtaagtttactttatgcctggttgcccctatctttaaatagaaagaaaacagagaaagaaaaatatgaataaaacaatgaaatttggaacaggcttgtagtttaataggatcgtactaacgttaattacctggttttgattattcaactatgattacataaaatgctaatagcagcagcagctgagtgaggggtaaataggaaacctctgcactatttttgcaactttttgtaagtctaaaattagatcaaaataaaaaattaaaaaaaaaaaaaagaaggaaaaaccatacctaacttgtggggttttaaaaaacaaatttggaaaatgcaatgcctggtactttaaaaagatttcagatataattctcctctgcttccctcattccaactttctgataaagccagaacagatggcccacggacttctggttcagaccttgctccccaagaaaaagtcccctcatactgcaggtatatgccagcactttgcagctagaacacctctcagaaaatgaatcgaggaagcagacgatgggaaacttcccacggtagtgaaatctctaaacctcttctctgacctttgaattcttggcagccacaagctacgttcttgccaagagtcctcacgcgtgtagcttccacatctcctcgccctcatttagagggtagacttcctccacactccagtcatccggtgccatctgtctgtggccatgaattagctgaaagctctccgaaaccgccttctcaagctaattgagctgctctaaatatttgaagagacagaaatggggttataccagagatggtttaataaaatattgaaagagcttttttctaacggtgtagtagtccacttccttctttcctcccccagggaaatatgcatcttatcagtttatcatccgaaatgaacttgactggtctgggaaatcggccacaccgtcaggggagagtgaaggagaaacttccgggaaatgatcagaactattttaaaatcattttgctagtgcaaatcttgaacattcataaaacttatctatgaagataaagactgaacataaagaatagcaatgggcttggcctcctaccttaaaaccatagagattgactgtgttaaaatatattgttgaggatctgtaacaggaaacagataacctcggaagttcagcgtgaagggctactgcaccacagtcagcttctggctacaagaggaggagtccatcagttcacaaaaccaatgacttccatcaatttatatttaagtttttttttttcactgaataattctgtccttctaatataaatctgacttttctaaccttgccttatacttcttggaaattcctacttaatatgagtccatataatcagaaaacatgatgaatttggggcacaaaaactaatttttatttatttatttatttatttgagacagagtcttactccatagcccaggctgaagtgcagtggtgtgatctcggctcactgaaaactccgcctcccaggttcaagtgattcttgtgcctcagcctcctgagtagctgggactacaggtgtgtgccaccacgcctgactaatttttgtatttttagtagagagagggtttcgccatgttagtcagtctggtcctgaactcctgacctcaactgatctgcccaccttagcctcccaaagttctgggattactatcatgagccaccgcacccggccagggcacaaaaactaatttttctactaacagttgctgggtatgccatggggcccatcaacaatggagcccactttgactcacagttctgtgctctgagtgagcaaaaacattaacctcaaggcctgtacaatgcctgagcattttctgaatcattaagtacaatgacgcagggaaagagaggacaggaagaaggctgggaccaggcccccttcaccctagtgttctgtcctaggaccgtgagtacagctgcagtcttaggtgtgcttgtagatcgggaggaggcaggaagcttgggaaggaaacagacactttggttgtccccatattgcttctggacccctcatggtgctctaagaaggagagagcaaatttgtctactgagagggacattgtagtggacatcaagatgcaagttagtgctttataaatttatatttcctcatcttttcaagttttacctctgatcatgataactcttttggttgttggtcgtactccctcctgtttcccttgactagtctagaaatccctcctccctaagttctccacccttttctccttttcttcaggccaaaatgttctcaagttgcctttgatgaaactagatctgaaatgacttctagttgattaatttgttcatacaatatactgtgaaactgggcaagagatgatataaacactccttgaagctagctggggaggactctgccactgttttttcattttacaaatgaaagagcctctatttatggcttttgatgacatagaatagtctatttgataaaaattaatagtaccccctctagttctaataaaaaatttatttattataacaatatctttataaatgtggagtgtcttcctcttaatgattttctggaactctagtggtaagatcacattttgattaaccatgcctggctaatttttgtatttttaggagacagggttttgccatgttgggcaggctggtctcaaactctataggcacgcaccaccacgcctggctaatttttgtatttttagtagagacagggttttgccatgttgggcaggctggtctcgaactcctgacctcaagcgatccacccaccttggtctctcaaagtgctgggattacaggcgtgagccaccatgcctggcctcttttcccattttctaattaatcatttgtcttattgagttgtaagatccctctgtgcattctgaatacatgtctttatcagataaatgatttgcaaatatttcctctcaagatatggcttggctgttttcttaacagtatcttttgaaaagcaaaaggttttaattttgacaaagttcagtttatcaatgtttcttttatagattgtggttttggtgttacatctaaaaactcattgcctaactcaagatcagaaaaattttctaccatgttttcttttagacgttttataacttttgctcctctgtttagttctattattcattttgaggtaattttatgtatagtgtaaggtaaggatttaaattcgctgctttttgtatggatatataattgtcccagcactatttgtttagaaaacaatgcttaccccctttgaattgcctttacacctatgttgaaaaccaactgaccatacatataaaggcttattttgggatctcttaattctgttccattgttgtatatgtctattctctctctctctctctctttctctctctcttttgagatgccagagtgcagtggtgagacaatagctcactgcacccttggactcctgggcttaagtgatcctcccacttcagcctcctgagtagctgggaccacaggcttgagacactgtactcagctaattcagctaatttttaaatacatatatttttttttggagagaagggatctcattttattgcccaggctggtctcaaactcctggcttcaagcaatcctcctgtctcagcctcacaaagtgttgggattactggtgtgagccactgcactgggcttatatgtctattaagccaaaaccacattgcctgataaatgtaggctggtcataaattttgaaatgagtggtgtaaatccgctaactttcttctttttcaaagttgcttggctgttctaggtcatttccatttccatatatattttaggagcagtttgtcaatttctggaaaaaaaaaaaaaggcctggggggagcttagatagggattgggttgaatctgcagatccactgcagaacgacagtcttaactacatagaatcttcctatctgtgaacacgtaatgtctctccatttctgtagatctttaatttttcacatccatgtttgtagttttcagtgtgtacttcttgcacttcttttcttacatttattcctaagtgctttgtactttttgatgctatttttattgttatattgtccattgctagcatacaggattaaattattgtagttttgtaggtcattggcttatataaaaaaaatcttataatctttttacaggaatcatatggtgacatgaaaagggttccataatatagtccccacctgctactccagcatcactccccagcacccgtaagtcagaatgtatgtttccctagcactgaacttctaaaaattgatacatgttagatgtccatgtgataatttcatacatttacataatcaaatcaaggtaacttggatatccgtcaccttaattatttatcatttctttatgctagggacattcaaattattatcttctagttattttgaaatgtccaatcagctaatattaactctagtaaatttactgatctacggaacaccaggtgttatgtcttctttcaagctgtgtatctgtacccattaatcaacttctcttccctcctccacactgccattcgcagcctctggtagccaccacactactctctatcttcatgagatccactcgctagctctcacagtctcacatatgactgaaatcatgggatatttgtctttctgtgcctgactcacttcccttaacataatgacctctagttctatccaagttgctgcaaaggacaggatttcatgctttttttatggttgggtaatattccattgtgtacatctaccacatttttcttatcctttcacccattgatgaacacttagattgactccacattttggctattgtgagcactgctgcaaagtacatgtgagtgaggatatcgcttcaatatactgatgtcatttcttttggatatatacttagtagtgggattgctggatcatacggtagttctattttttagtttagtttttttttttttttttaaggaaactccatactgttttccacagtggctgtactaatttacattcctactagcaacgtatgagggttcccctttctccacatcctcaccaccatctgtcattccctatctttttattttaactgggataagattatatctcactttggctttgatttgcatttctttaatcgtgagcactgaactttcgacagtaccctgcaaccttatgatgtttttacttaaatttaatttcaacctcaagtctcagtttatgcattacctcatcctagaagcctttcccgttttctctctacttgcgctacgctgcatacactggggaacgcatgtgtgcatggacactgtcatttctataccaaattttaaactatactaaattttaactaactacttacatgttcatcttgagaaacctgtgtcaccatgtatagcaaaacctgccagttgtttatcgatatccatcttctctttccaaaacaatagaacccctaattttttgctaggcataaagcaaaagaaataaagaccatatttctggccccgcttgccattaaatgcagtggtacgattatcttgcatccagtgagagaagctcatcgggcagctcccagaaaccttccctcaaaaacagccaatgcatatcttgtttttctttttctttttttctttttttttttctccttcttgccagttaaaccagatctgctaaatgaggctagaccagccaccctgagtggatgaagtgaagtgactgtgggaacagagacccacatggggcaaagcaacaataggaggggagcctgggtctccatatcccaccctggtctgcctacttctgggctttccatgagaaagacacacaattctccctgctttaggctgttatttccttgggtctctcttaactgttgccagacttagtcgaaagaggtttataccacatcctattgcatcttcagtacctggtgctgtgccaaacacatagtagttacttaattaatgtttgctaatttactgcaaaaggatagcaaaagttaaaaaaaaaaaggaaaaaaagctttatggaatattaccttcaaatccatcctgctccacatggttaccaaatctctttccaggataataaaatcttaacattttaggcatacaatttggccttcaaaggcctctcagctttttaaatctaatttctattctaatttattcatcatgatgttaataagatgtttggtttttcatgtagaaggaaaagcaaatttatacaatgattccatggatagtcaagagacagaaggcctgtaattgactataataatagatctcacaaaatcataaaactgatagtaacaatggggttcaagcaattaaacaattttgattccacagatgaaaaagctgatgttcagagaggtgacacaactaattccaggccacacaaacattgaatggcagatctgatgtcagaacccagataatctaacttccaacttggtactctcagaatcagttagagtgcctttggttgtcaagagcagactaactaacataagcaaaaatccttttaaaatcttagaatttacaggatccaaagcctggaacaggcaggaaccaggcagctctgttcctgcctggtttccatggcaacatcagctacagagctcatactgatttagctgacggaatgaatgaataaactccaacaacggttattgttctgtttttcattctgattgtagaatgcttctttttcttttcttttctttctctttctttcttcctttatttttctttcttcctttcccttttctctcttttttcttttttctcattctctctttctttctctttctctctctctttctttctctctctctttctctctttccttctctctctcccttcctttcctttccttctctttctctctctctctctctcttcactcctttccaccattatttttgcttactgaatctgcttcccagaacagtggctgatgagaagcctaggcaccaattttctcattcccatttccctcaacctaatatagggagtgagatacaagggtgaacccctaggagatgcactttgagagagagagagagagagagagaaagacagacagagacagaggagaggagagagtaagagttagctctctggctttcctggcttcctctcattttctgtttttatatgcattttatttgttcacatgtttttaaagtctgcagtttgagaccatgagatgacaaggagagaactgaaagccaaacttttgagaatacttaagagaaagttaccaagtgcctgagtcttctatgatatcactgagcaaatgacgacctccgccccccatattttagaaacaaataactgaatgcatgaataccgtaaaggaagatgagtacatacatgtaagcacttagagaaatgagaaaccaccttgtatttttatctggaaactaataaaaagcaaaatgcatccaggaatattatacgacatgcaatttcgcaattcaaggtttttctctttcagtgtgtagagttagccataaagcaaattgacagatactgaatgacctagttaaatcttccacggatgctaatatctcctgttaacaccctgcagcttgaccctaaggacttccgcgcacccatcacatgtatagtatggtgtttatttcttgattttatatttttaatatataaacacattggttatggacaggaaagaccttctgtcttattaaatgactcacatgatttgcctcgaaaccacaagctaagtcaaacttgtgctaagcatggtttaatctgacagaatataaagattctaggacaaatcaaacccaagtgaaagtttccagttttattgccacacccaagttcgataaagaagcaatatgagcttgaattaaacttgcagccgagaaaggttacaacttgaatatagtattgagcagaaagaaaactttccatggatcaaggactcaacataattctaggatctataaaaaaaatatccatctgatcttcaatgtgtgtacattctaggagtaaaacctatgctttgttaatattacaaagtaaagcaatcttctttcttcccaacagcattgctttgcccattttagtctgttatgtagcattatccatgaagagcacgacaagggaaatgtacagcgagcccttgttaatggtcttcggagaaaatggtttaattgcacagacaaatgctgagtcaaaggtgattgtgcaagccagagaaggaagaaaagaaaatattttttaaaattagccaataatccatttataaggacaacaaacaatagaagcttaatgactttttgccatattactaaaacatgtaagaattacacgtgacttctggaacacaaaattcttaatcccaggtcagaatagttaattcaaaactaatttgttttcagggaacatatctgagaaataataaaatgtagggtctcagctcacatccacccttgctcagatgaatgatcataaaaatggtcctaggcaaggccacagggtctggctggctgaggactttgtgcactggaccatataccatgagcagtgagttatttcaaactccagctatggggccagaaactccttaggagtccgcaccagaatgtctagaggagcacgtatattaacaagcatattttacacttaaaaaaaaaattaaccacagaaactgagattccaccagacttccttgataggaagataaattgtaaaagttttactgaaggacttaatttttaaaattaagccatttaatttaaaaaaataagacttttaaaacaatgttgagaaacacacccttcaccagaagaagaaaggggcgtggccagggaagcagagcagttccgcctgtacctggtttatgcagtgcacttctgaatattgccttcgaggaaaggttaggacaggataaagcctccagacaccaccgttcgagtataatttgagccaggaaagctgtcagtgcagctttttactgtgttgtagaatcctttgggaaagaaatcttttcttgggttcctctgagaattccgactgaggcaaaaccagatttatcagggattttgcagatatcctgaaacaaaccgtctctcagcgtgagtctaaaactccatccgccaagaccgtcgctgggactaagccctgaagctgagtgatcacttgcttcctctgctcctctctcgtaagaattccttccctcaaaggcctcacaggctagatagggaggcagacacaccagagaaacaacagtgaagcatgcaaagtgctgtgaggaagtgttgtgcaggtattgtagaagctcagattgggagtgcctagggctgaccgacccagacagtcttttatactgggcatgtgtgtgtgtacatgcatatagaaatttggggaggagaagaaaaagaaataaaaggaagtaatagtggctgcaacttctgcctacagatactatgaccttgtatagataatgcttttgtgactatgacttggccttgcttgcaacccaccatctgagtcctgctaaccgaggaccaactatttaggaacaagctacactgtgccaccaaaacagacatcaacaacacctttattacatacacaattgccccaagaatttttatatatactattttcctttgcagcaactttactcaccctctctctcttttttcttttaaaatttttagaggagtttcactctgtcacccagggctggagtgcagtggtacaattatagctcaccgtagcctcgaactcctggggtcaagtgatcctcctgcctcggcctcctgagtggctaggattacacatgtgtgtcaccaggcccggctactaagctactaaccctctcttaaatacaagctactaaatctattgaatgatccgggaagaaacaatatgaaaaataaaaagataattaagaatttcacaaagcaaatatatgtataatgtctagaagaatcaaagatggaaagataatatggtaatatgacactaaagagcctgatgaactttttgatttgttataaaacatttaaaaattttccttcaatatttaattggccaatgagtctccaaatagctattgcctctctctcttttttttttttttttttttgagatacagtctcgctctgttgcccaggctggagtgccctggtgcgatctcggctcactgcaacctccgcctcccgggttcaagctattctcctgcctcagccttctgagcagctgggactacaggtgtgtgccaccacgcccggctaattttgtgtatttttagtagagacgggtttcatcatgttagccaggatgttctcgatctccggacctcgtgacctgcctcccacggcctcacaaagtgctgggattacaggtgtgagccaccgcgcccggccatccctctctctaactcttaatccacattgccatgcattggttccctgctattaacctctttggttctaatctagatgatggcatctgctggtcagtgtcctggtccaatgtggatcccatccagcatgctctccaccttacatgcagagcagtctttgtaaatcacaaatctcatcatgtccccccttcactcaaatgcttagatacagcctttcaggataaagtccaaactttttagccgtctataatctgactcttttcttgttacttgctcaatttgggacatgtactctggacaaatgaactgtgtcataccccaagcacgccatggtcttgtgtgccttcatcttttttactctccactccttaccagggatgaactgcctcccattctcagtctagatccgtggttctcaaggttctcaagggaacagtggcgacagcagcaaacgggacatgtcagaaatgcaaatgatcaggcttcatctcagatctcctgagtcagaaattctggagaatggaccagcaatctgcaaataaggactatagaagatcttataccacagaaaagctaggcagcgtgcagagaactagagggccatcgatgacttctttgcctgcagttcagcaaatacacagcagaagtgaagaccactaggtcacttggtcaagctattcataaaacagaagtggctcaaggagaataaatggattatacgcagggacccctgtagcttgaggagtcagatagacattatagaaacagagactgtcagtgtcccaggggtccaggaggtcaaatagtccagtctcatcatgtcacagaggataaacaggagtcctggaaaggtgaaatgacttactcagtgtgagacagatggccaagagaacactgaaaccaaagtgttttagaaggaaaaagctgcatggtaaaaacagctgagtcatctgatggacactgacacaggcaagtccctcggtgggcacccaggcagaatgagaagcatgacatgtttgttcttaataactcagtgggctgatcctgcagtctaggcaccctgctgacgggaagaagcaacgactcagttagactcacgtggatctgtccagcactggacgtcagcagtagataggtttgatggagctggaaagtttatcctttaaaaatggccacaaatattacacttataaatatgtatgtgtgtgggtgtagaaacattacttgtaaaaaatgaaacctgttagattagatcaaactaggttgccgcttctaaggtagtgaacgtgtaaaagagtaaacctcatagaaacatgaggctgcccaatgcatgtgtacatgttggtgttgtgtgcatatacttcatcatatacatatagttagaaattgtatgtataattaaaaatataatcattcaatcataacattaaacagtgaaattattacatcataatgttaatcataacatggagcaattaaactacagtgttttatgacatatagttttaaattataacattaaaaatataggtaaacggctaggatcggggagcaaatattaaagtaaataaatccctgccctactccctgagccctttctgctcatattttgcactcttctgaggactgatgttggcctcccaggcttcaggacaacctgacatcaagatgcctttaggttctttctgacagctgctgctgcttcttcatcacagagagttcatttgctctcctcggcaggccagagctaattaagaagagaacagcccaggttcaccctcccaaccctcctcatcggctagaactgcctgtttgctgccctccaggtcttctgcagtgagaccccctgcttttctccagagagtgaggaaaccaccactagaggggtggggtctcaacacagacatatttacccaacaggagcagaatgtttccatttgacaattccactacaagaagcaggccttcttggacctcttgcccaacttctggccttctgattctaagtagaagttgtcatttttctatgactactattaggttggtgcaaatgtaattgtggtttttgcaatgaaaagtaatgacaaaaaccacaattacttttgcaccaactagtgctagcaatgccttaaaaaataaattgggctcaagatttcttggggcataaattgttttgtgctgttttccgtttcatctccatgttccacgggcttaaacaccacagagcaaaggcagcacgtgtctgtggagctgccccctttccaaggaagctgctttgaccttcaccttctgcctcctggtagtgtgtgatgatcacatggaatagtaaccagagctgtgtcacacttcacaaaacaccttggggattttgtgacctcaaagtattctcttcacctggcaggtggcatgagccatgggagatcccgacactcccaactttgctaccaatgactcagatagagggacacatgtatacatgtgtctgtgcacattaatggaccagcactggccatgtttctatgaggccttttcttttacatgattaccatttaagaagcagcaggtgaatctaacctattttgttttcttacaagtaatactgtgttcgctttttgaaatttcttttctgaactttagtaaaaccatttgctactctttcactctctttttgtgtttttttttttaatttttaattttgattttcataggttttgggaaacaggtggtatttggttacatgagtaagttctttagtggtgattcatgacattttggtgcacccatcacccaagcagtatacactgaacccaatttgtagtcttttatcccctactgccccccaccctttcccctgagtccccaaagtccactgtatcattcttaggcctttgcgtccttatagcttagctcccacttataagtaagaacacacaatgttcggctttccatccctcagttactttatttagaatatggtctccaataccatccaggttgctgctgctgcaaatgccattattccgttcctttctatggatgagtagatagatagatagatagatagatagatagatagatagatagatacaatttctttatccacttgttgattgataggcatttgggttggttccacattttttgcagttgtgaactgtgctgctataaacatgtgtgtacaagtatctttctcgtataatgacttcttttcctctgggtagataagcagtagtaggattgctggattcaatggtagttctacttttagttctttaaggaatctccacactgttttccatagtggttgtactggtttacattcccaccagtagtgtagaaggtttccctttttaccacatccctgccaacatctattattttttgattttctgattatggccattcttgcagaaggagtaaggtggtatcacacggtggctctgatttgtatttccctgatcattagtgatgttgaggatttttttcatatgtttcttggccattttcacatcttcttttgagaattgtctattcatgtccttagttcactttttgatgagattgtttgttttttcttcctgatttttggagttccttgtacattctggatattagtcctttgtcagatgtatagattatgaagattttctcccactctgtgggttgtctgtttatactgctgattatttcttctgctgggcagatttttttagtttaattaagtcccatctatttatctctgtttttattgcatttgcttttgtttttgtgtgtgtcttttgtttttctcctctcccactcttatccccaacccaactttgatttctctctttattctctagaacgtgaattaaccagcagcctgcatttcacatttaactgaagaagcagaattgatgagtgtcacctgaactatcttgaacatttcatgtcacattgcatgtcagatatttaatcttgacacctcctctccgtccagagccaaaaagtcaccaggaatgaagaattctttcttcatcatatagaattttgtaggccatggaaagcaatctagacattattctaagtgctatagaaaactgtgtttgagttttgagcaggaaagtgatatgatttgaattctacttaaaaactcaggctgggaaatagaagaatgaaagcaaagagaccagtaagaggatttattgcaagaatgaaaggatcacatgactatgggggagagaaatggatgaatttgggatatattttgtgtgcagccaacaagacaaaaattaatgcttgcaaggaggggaaaagaggcatgaagggaaagagatggatcaaagaagattcataggcttttacttgagcaactaaatccttgcagctgccctttaacaaaatagggtacagagggataaaggaaatttggagagagaaggaataaaaagttctattttggccacattatgtttcagatacctactaaacacacaaatagaaacgaaggaaagtggtcaccttattttaatgggaaggcagcaacctgaaaacctagtcatcctggagcatccagcagagaaaatttctattgcaagaagtaaacacttgattttgccttccagacagatcatttcattattcaaagaacattttttttcagaaggaccatgagatatgcaaatatatagcagagatttttcagggtacacaggtgttagaagctaaaagtagtggagcaaggtgacaaaaaagagatcctttctagcgggcagtgaaatgcctatatattattttctttagagcaagattccctttccaagtatgaacttaaactgacctatccaggtacatattattattttcttagaaaatgtgtgtgtgtgtgtacacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccaccaaaaagtgggcaaaggatatgaacaggcacttctcaaaagaagacatttatgcagccaaaagacacatgaaaaaatgctcatcaccactggccatcagagaaatgcaaatcaaaaccacagtgagatatcatctcaccagttagaatggcgatcattaaaaagtcaggaaacaacaggtgctggagaggatgtggagaaataggaacacttttacactattggtgggactgtaaactagttcaaccattgtggaagtcagtgtggcgattcctcaaggatctagaactagaaataccatttgacccagaaatcccattactgggtatatacgcaaaggattataaatcatgctgctctaaagacacacgcacacatatgtttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccattattctcagcaaactatcgcaaggacaaaaaaaccaagcaccgcatgttctcactcataggtgggaattgaacaatgagaacatatggacacaggaaggggaacatcacacaccagggcctgttgtaggttggggggaggggggagggatagcattaggagatatacctaatgttaaatgacgagttaatgggtgcagcacaccagcatggcacatgtatacatatgtaactaacctgcacgttgtgcacatgtaccctaaaacttaaataataataaaaaagaaagaaagttggacttaagaactgtaaaaatgcaaggtgatataatttggatttgtgtccccacccaaatctcacatcaaattataatccccagtattggaggaggggcctggtgggaggtgattggatcatgaggatgctttcttatggtttcgcactatccccctagtgctgtcttatgacagagttctcaagagatctgcttgtttaaaagtgtatagcacctccccacacccccctcctcttgctcctgccgtgtaagtgtgctcacttccccttcgccttccaccatgattgtaagttttggtgatgcctccccagaagcagaagcttgcacagcctgcagaaccatatgccaattaaacctcttttccttataaaaaaaaaaaaaaagaaaacgtgtgtgtgttcaggcctggcacagtggctcacgcctataatcccagcactttgggaggtcgaggtgggcagatcatgaggtcaggagttcaagaccagcctgaccaacatggtgaaaccccatctcgactaaaaatacaaaaattagccaggcgtagtggcaagtgcctgtaatcctagctactcgggaggctgaggcaggagaattacttgaatctgggaggcagaggttgcggtaagctgagatggtgccactgcactccagcctgggcaacacagcgagactccacctcaaaaaacaaacaaacaggcaggacgcggtggctcatgcctgtaatcccagcactttgggaggccgaggtgggtggatcatgaggtcaggagatcaagaccatcctggctaacatggtgaaaccccgtctctactaaaaacacaaaaaattagccaggcgtggtggcgggcgcctgtagtcccagctactcggaaggctgaggcaggagaatggcgtgaacctgggaggtggagcttgcaatgagctgagaccacgccactgccctccagcctgggggacagagcgagactctgtctcaaaaataaataaataaaaaaccgaaacgtgtgtgtgtctgtgatgatggggtgtggatgaagactgggcaagctatctcaaaggcaatcagaaattgacattccccccaaaatccaaaaatagcaggaaaggtatgtaggccacagagtctgcttgagggtgagatataattatagaagggaaggaaacctggactgataaatctatctgtctttttccacttgtcatatatataccaatgcttcactactaaggtagtgaaccgtgatagagcatggttgtgaaattgaaatcctgggaccagaccatgtccctgcgggtagaaggtaaaattccttccaaaggaagtagatatttttactgtctgtgttccaatggagagatccattccagtactaatacgaagtttaagaaggcatgtgttaaactagaaaaaactgaagatgaaaagaacacagcttcctcctaagagacttagaggaagcatggctctggatttcgattgagtactatctacctgtgagtagtccttcgggggtaggcaaagtggattctgcaataaggcattaggccagaagctaagggtctgggtatgttggctttaatagttaccatatctagttgctattataaattgtcctctttgttgtttttttttctattattgaacacactgtaaatcttgtagaattagaggcccatgcttggatgaaacatcatgggggagagcagtagcagtccaaagggagccatttcaggaagtaggggatacatgaacgtcagctgtggcccttgcgcagaactgagagtgctggctagctgaggaacacagcagcaagggaaggaattagtttaacagttaccatctcctagaaactcccagaaatacacagaaagaaaattttgcaaaagactaaaattactgcattcaagcaggagggaggctgggaccattgtacatatgttctttaaaagggaatatgttctcattttatctaaaaatgagacacacctggcacatttgtctgtctccttctgtaggctataagctctttcaaaacaaggacctatcatgtcagaaagacttaataattatttacaaacgaaagaataagggtatccttgaatcaagcctttaatttgaataactcgattggttttacagtagcaccaagttctacttcctcatttacacattgtgaattacaatgctattattatttggaagtaatggcttttaaatgagcctggagttgaaatcgtaggaagaaagtagttctgtgtatgtaaattatttggttgatgaagggggcctgccgctccacacctgtgggtatttcttgcaaggtggagacgagagactgaggggagtctgatctctctttcccccacaggttgaaagagatggttgcatgctgttgttctttaccaataatgccagggataactagccacggagggtcaaagggtagtaaggctttgtaacaactttcttaatgcaatgcaatcatacaggtggtatgcatggccaccaaggagatgcagattggatttaactagaataacctggggactaaccaaggttccttttctcaactaaaaaaaaaaataggtatagtgatgctaaatctctaaatactcttagaaagattaagaaaataattataagatatatgtcctcatgatggaattaaaaatgaatgtattaatgtcttgtattggtagatttgttttatgacccagcatgtaggctttcctgataaatgcttcacgtacacataaaatgagtatgtaatctgcagtaattggatgatgtaaataactctctatatggtcaagctgatggatagtgtttcttgagttttctgtatcttcactaatggtccatcacttgttctgtaaattactgagagaagaatgttaaaatgtccaaatatctttgtgaaggtatatctttctccctttctgtcactttttgcttcatggatactgaaggtatgttattaggtgcataaacatttaggattgcgaatcattatgattttaccctttttatgtctaataagacttcttgtcttgaagcctattttgatatttatacaaccatgtgcaccttcttgtggttagtgtttgcaatgatgtgtatttttccatgaatttactttcaattttttaattgctgtgcatctttatatttaaattatatatgtgcagaatcctatggctgggtcctgttgtagatatatatacatatatatatatacgtatatatatgtatatatacatacatacatatgtatatatatatacatatatatataatcaaataatctctgccttttggaaaaatatattttggtcgtttacatttaatgtaagtattgatatgactgtggttcagtctcccatcttgctggcttttttaatatttggcatctctgatcttcgttactttgtcccttatctcttcctcatttcctgtgttcttttgtgtgaagcagtattttttttaaaatttcttctatctcctccactgcattttaagctacatctctttgtatttttaaattcattcctagagtgaacatatgcatccttaaagtgtcacaatctactttgagcaccaatactaaatgttagggattcaaacacgagcaaggcatatccctccttttcggatgagtggagaaggcagacatgtaagtaataaatacagcaaaacctctcactattcagaggacctttaacatggccacaaggctcaagcttatcattcgacgaacttgctaccagtatttcttggttgtacagattattttttcctcttcgctcactggatttcatatttgtctgaaaacatttcgccctgtttttaactaaattgtgttgtcatttgtatagtctatatacaagtgctttgttggatatgtattttgaaaagattttctcccaatctatatcttgtcttttcatcctcttcacagggtcttccacagagcaaaagtttctaattttcgtgaggtataacttattgattttttttggtttatagattgtgcttttcatgttgcatgcaggaaaactttgtgaaacctaaggactctaagattttcttctatagttttatagtttcaggtttcgattttcactatatgattcactttgagtcaatttttgtatgtggtttatggtaaaggtcaagatttttttttttttggcatttgactatacctaatttatcctttccccattgaattgtcctagcattttgtcaaaagtcattgctcatatatgtcatctatttctagactactgttcccttgaaatattggtctatttttatgccaatactacactgttttgcttactttacaataagtcctgaaatcagtagtataaattccttaactttgacgtctgttttcaaaattattttggcaattccagacctttttcatttccatataaattttataatcaatttgtcaggttctacgaaaaagcctgctgagatttcaattgagattgcaatgaatctatagatcttttgggggagcactgacatactaatcatatcacctcttctgaacatatgcattcattatgatctagcaatctctttctaagtatgtcttagaaactcttggacaagtgaacaaggaaatatacacaaggatgcttctagtactgctgcttgtaacagaaagacaccagaacattttccttatcacttgagaagatagaaaaatggtggcatatttatacagaaaaaaattttggaatttcatgtggcagttaacaatgaattgactcataaacataacagttacattttaaaaaaggaatatatatagtattatcctatcaatattacattaagaaatatgtaaaaccaatcacatgttgtttgagaaagcaaatatatgtgttaagactatacagaagaattaggaaattataaatacaaagttcataataaaattcataatgagctttttacaggatggggaaagcaataaccttgggagggccacaaagttgtatttcttaatcttgatggtgagtacacagaatgttatcaaagtgttattctatacagcatatatgtattttagtatatccttttctatttaatatttaatatctaaatcatttttaaaaggaaagacagagaattttatcgagggggaggaatcagagtaaacttaaatcttacactagtgaaacagggcacaagcatttatggttcaattgtgtaatcgattcttcatttatactattccatttgcagcttatgaactgcaaaacagcatcctgaataaatactaggagtcgccaatgtaaacctgttaatattgtgggatttttttttttttggacactcaccttctgcaaagtaacaaaagcactttaaaatgtgagaataaatgttgttgattgcagaagaataccagggaaaatagcacaggccatgcctttctctcttactcctcctattgggtctgcaggcctttcgcttgcatgagtcatccatactcaggtaagcactgtgcctttattctttattgcactaggcctcttgacaaatgactgtttaaggagtgtttgcacacctgtcaatggttcctgtcatttgtcaagtaacaaatataaaatctgataactaaacaggagaaaacctgtataaaccaagaaatattggtaccataagaagttcaacagatgataaggctaagccctgtggctctctggaagcccctccgaatagtgagtggttctgctgtatttgttatttatgtgtttgtctcctctgctcatttaaaaagtagggactatgccttgctcatctttaaatccctaacacttagcattggtgctcagtaagtgtccttaattgatggaaactgatatctgttgatcccaaataaaaacaggtcaaagccatctttcacggcatattttcaaaccttctgttttcgcattaaatcgtgaaccttttgaaagtatctacacacttttaaaatattttggaggcattattcaaataactattttgatactgagaaaatactaccagtggcatagatacaaattaactcctggatgcttttaactaatttttgtgtttggtgctaatgaaaaagtacctgaagcctttaactttgaagcccgggcttcaaagacatgattgctcagatgtcttgctttattgttgcagtttagcaagacaagaaactctcccaaaatgtcttactattatgtactcactgtagagaaaatatgattgtgaggaagaaaagtaaagaaggaaagcagtgtgagagttaagcacttgaagtttgcctggagtgaagaaggtcctaccagttaagtgctttggattttttcttttttcttttctttctttcttttcttttttttttccagatggagtcctgctcgattgcccaggctggagtgcaatggcgcgagcttggctcactgcaacctccttctcccaggttcaagcaattctcctgcctcaacctcccgagcagctgggattacaagcgcttgccaccacgcccagctaatttttgtacttttagtagagacggggtttcatcaccttcaccaggctggtcttgaactcctgacctcaggtgatctgcccacctcagcctcccaaattgctgagattacaggtgtgagccaccacgcctggctgggattttttcaagaatgtgtactcaaggtccaaacttttagatcatttgaaggaaatccttttgccactctcaggtaaatcactttggagctctgtaaagagtaaaacagccctccgcagccacacacagatttgcatggtggggctgcggagcctcggagtccaagcgtgacttatagtccctcataagcagaggccaagaagaggccagcttttggctttttctttctttctttttcttttttttttttgagacagagtctcactctgtcacccaggctggagtgcaatggtgtgacctcggctcactgcaacctccacctcccaggttcaagcaattctcctgcctcagcctcccaagtagctgggattacaggcgcccaccaccactcctggctaatgtttgtatttttagtagagatggggtttcgccatgttgaccaggctggtcttgaactcttgacctcaggtgatctacctgccttggcctcccaaagtgttgggattacaggcgtgagccacagcgccggaccttgactttctttcttgataactgtaaaagcaactgaaacagatgatgaaagaagaactcactaccatgagccagagcccatagttctcaataactcaccttgcccctgagctgacaccctcccacaccctgcaacaaatacatgtggttttctttctttgagaaacatcactatatttgggcaacatgtcacacacagcccagtgtattctcggtttcccaagtaacctgtagagaaattctatgatgtgatgccctttttcctggaggaccatagaattcagagggagaggaggccttgagaccatcctcaggtctcctgcctgaatgttgctaagcctcaggactccctccacccacatgcaaccacacatagcttttacaaataaattaagagtaagtcttttgcgggtaggtattatggcattttcacctcctctaggcagaagtagtgtggtgcatttttaaggaaggggaggttgctttgcacaggcctggaggcagaagatctagtcatccatatctccccaaagcacactgccccccttatcctcggacttgcttctaagatttgctgtcttgctgagaagttagcagtactcatcctctgaagatgctagactttccagatatttggggaaagccaatgtaatacatagcaccctaggtcagaagtgtgccttgagacagagttctacagtgattacatattttcttcctagtctgagcagccacatatcaactatcaagaaggtttctaccctattcttgatgctatgcctatgcagtttaactccagaatttatgaagacacataatactgttgacagattggatgagaaccattatcatttccccagattatcgacatgtagcatgctattagtaggagacaagcagtagattatgatgtcagtctgtttatgtgtcttctcactaagagaggtgagaaataaaagccagtggggatagaagactggttttggtctggcttaaacctccatactgtggggttttattctacgtagtttgctgtaaacgtgtgcccacttcttccttcttgagggctcccaggtggccatagatctctgtgacatgaagcttctttggagtattctgatgataaaagggagaatttcaattccatttgacaggaagagtcactccctccttgaagtggaaatgaaaatggatccctaactgtgcaagaggcaacgatgaaatagctctccctctgaccctccattaaatgacagcaggcagtagaattattatttggtactttatgcccaccgttgtgtcagctgtacacatgggccaaccacacatttctctccttccataattctgactcatgctgcatgggcttgagaacaatgttgaaaagttcccccagggtttctgatttacagtcccctcccttttccctggtattcaactaatgatttagaagctggaagtagaggaggctcttcttatttctgtcaaagagacagaaaaagagcagtcagagacagactaagaaatcatgattctaggaatggaatgtcccattctagaaggacagtgttcaatgtggtgaagaaattgaggaggagagcagtaggcagaggttattggttttgatggtgatagattctgttaagaaattagtggtaaaatcctggctaacacgatgaaacaccatctccactaaaaatacaaaaaattagttggatgtagtggtgggcgcctgtagtcccagctactgggaagactgaggcaggagaatggcacaaacccgggaggtggggcttgcagtgagccaagatggcgccactgcacccagcctgggcaacagagcaagactccatctcaaaaaaaaaaaaaaaaaagaaagaaagaaattagtggtgaagccatgctgtaaaggggttagaagaatatgggagtagtttgaagatgtggcaaggtcatgtttgtgaacaatggaattcacagagaagaaattttcttgagctgtgatttagtcagattgggatgctagaataccacagactgggtggcttaaacaacaaaatttatttttcacggttctggaggctggaaagtccaaggtcaaggtgccatcatggctcttcctggtttgcaaatggcgtcttcttgtggtgccctcacatgctggacagacaaagagctctggttccttcatcttctaaggatactaatcccatgacctcatccaaactcaattaccttccaaaggtcttacctccaaataacatcacctcggggataacggtttcaacatataaattttggaggagacacaaacattcagtccatagaaagattttttttgaggtttcaattgtataattcttatgaataagttacaagatgtcaactatttattctcagaataatgtttaactgagtaaattgcaaatctataatgatatagtaaaaaccacattgtctgggattttaccacctggaaagtgctagatatcaacacttctgacatttcccaagaaatatttaatttattcctgaggctgatgccaaaagtcaccaactctatgctgaaacacccactacatagcatcacagaatttcagaactgggcaagtatcccatccaaccaactatccttctacagatggagaaacataggcctcatggagaatagaagatgactgttgaagtcctttctaaccctgaagatatataatctcagaaactagcttgctaaagttcatactattcttttaaataagtgaacaccattctctgatcctgattatgtcattactagtgggcaactattgttttttaattcatctgagtgataaatgtgaaatagtacaagcagactatcgccagttctgaatcagctgagtcctaatttatgaggtataaataaatgtattttgagcttctcctgggaatgagagcctatctataatgtttcaatcctgaaaccaggttttatagaagagagactggcattaatcatcacctaaaatccttccaactcatcattgacaggtgtagttagtgatacccatggcttttacacaatgttgtttaaccaggaccaaatagaattctaggaactgattgtccatgacaggaaatcctacctaaacaaaaggcattctaagctcacacagaaaaatgagcaggcctgaacttgagggaacacaagaatgacaacaattgctacatttaaaccaagtgaggggggtaaagagaaactgctgtcagcatttagggagcccaccatcctggttgaagcagacagggcttgattcctgagagatctgcaatgtgcttccttctttagataaatgtggagagaattctgcattcatatgcaactggaattctgaattctgcattcgtattcaactggaattcagagaattctgaattcatattcgactggaaatatggtggttcctaccgcgatgtgcttttctaaaactcccaaatgggtgttcactaagtaaacatgcatttcaaagagaacttaggtaattcccttagcaagagaaaccagaaattctgactggggctccacaatatgtttatgaaaataatctatgtttccggaaattttgggacaccagcggtaaagaaagaaataagactgagaagtccttgaaaatgacaaactaaaaagaagagagatctggaacaataataaaactgcacatagatgagggaaagtttcaagatcttttaagataccagttaactaattgggaatccctgttctgtaattctctagccacacctcccccaataaaacaaattcatttcagcaagactgaaccatcaatttcttatttatgtaagaggatatagaaaattagggtgtcaatattttaaaatttatgcataatttaaaattatacattttttaaaaggctctgggtggttgtaaaaatttaaattccctctcaaaagatctttttggaaattattaaaaagactatgctctgaaaaaaatgtttgtcaacacctggcatgatttcaaagagtgatcctgcacagaaaagtaccaaccagctgatatccacagaaacacttcactgtcaatcattgaggatgaggatccaccataactgtgaggtattcctgttggtcacttatttacaatttcttcaagcaactgtcatactcaggtcaggttgccataacaagaataccatagactgggtggctgacacaacagaaatttatgtctcacagttttgaaggctggaaatccaagatcaaggtgttgccatatctggtgtgtggtgaggggccccttcctagctggccaatgactgcattctcgctgtgtcttcacgtggtggagagcacagggagtgagaacaaggtcttgtgtctcttcttataggggcactaatcccaaccaggagggcttcacactcatgatcaatttacctcccaaagaccctacttcttaatatcatctcattttaacacatgagttttggggaggcacaaatgttcagtccatagcaaggatatttgtcaacttctcccgtaggccaagaccccagttattcttaaactaccactagaaatacacacacacacacacacacacacacacacacacacgtgtgtgtatctatatatacatattgtatatatatgtgtatatatgtgtgtgtgtgtatacactatatatattgtgtatatatacagtgtacatatatacacacacacattgcttttctaagactactgtcttagtccatttgggctgctataacaaagtatctgaaaccggataatttataagcaacaggaacttatttctcatagtcctggatggtgggaagtccgagatcaaggtgccagcagattcagtgtctgttgagggtatgatctctacttcatagatgtcacctctttctgtattctctgacagagtcccccaaacccttttataagaaaattaatgccattcataagggtagggccttcatgatctactcaccacctaaaggccctacttcttaatattatcatattggggatcaagtttcaacataaattttggagggacataaacatttaaaccatagaaatcactgtctcctaacagacacttaggaatactttccaaaaaacttaaaccaacctagattgtgccaaaattaaccagtcaatgaaataaaaatttgaaaaaatttgcaacactgtgcccaaaatgtttttatctaatttaaggggaaacaatacatttccctttggggaattaaattctgtccaaagtgtgagtaaaacatcaagttttaattcagaaggccaatggtaaggagattctttctccaccttctcttttctcacctctcattctcctaccctccttgcaagcacacacaaaggaaaaaaaatgtggtctacattgcctcatagataaggaaccagaggcacagagaactgaaatgcttcactgtatttcatgcagaaagtgtttgctagaattagaattcacttttcactctacaagaccaaacacgacatagactatatagttcctttattgtcattgaagatttaaaatctataacacaatgcaggtagaatgatgtaaattatgtaaagatactcatatagtataaaggtattataatatagtatgtagacactatgaattccaacctcctaaaaacttagctctcctgaaaacctcagagtaaagaaaagtctattgactatgtaatgagactatctctgataattcttatatatagtattctggattggcaagaagtttatttctttttttatttcatcacattcatttagatttatggaagctggaaagatttcccttctcttatggaaatggaattaattgcagcacttcaataatctcagtgaaacccatttcccctggggaaatgaggaaagagacctagacttaatgtagataaaacaaattgacatgggacgtgaatgggagagaaatgagaaaaccattctagactaaaggtcttacacatttcaggaacgagaagtaatagagggatttttattggcagaacttattgaatctcataatttataatgtttaaagctactggtgaccttttcaaaagcaattaattcggttacatatttattgggagctacatcaagctttcaggagtcatgcacgcataccaaggtctttaaaggaacagaattaagtagataaaaggaggaaatcataaaatgtaacatcctttcccaggtggccacagcttgttcttattctatgcttctattagtaaagaccaaggtcacacaagtcagaccacttagagtcctaacaaggaacagacacccttgcaggttctaattgaactgatttgggctagaaactctgtgaacatcactgaagcctgaattttaacaagcaaaaattcaggagggaaaaactattcagatggtcttctacgggaggcaaaatacaaggaaacttttctacgccaacgaactttgcctagcaacgtgataattcacagagtattatcctgcaggcttcaaagacaacagacaatcagcctaaaagttacacctttgcttttaaatttcttcatataactaggaatactggtgtaacaatgtcaattacagcagggggccatacttcacaagcaggaaaattgtagagagatacaggtatgcgccccagttcctgcccctccctttcccacaatggaaagaccacctttcacttcttcgctcactccccatacttccagttaatagcatcaatttcaaatactactacaactttctcatgttccaaaaaattgacaagcacatgaacatccgttcaattttctctggcaaatatttatcaagcagcaaataatgtggcactatactagccgtggtattgattaggcattatcctatcttcaagaagttcactagttaatggacctttgggtgtggcatataaaggtatgataagtataagggccaaaaagacaccacaaagaacaaaattaggaacaaattatgtattactggccaggcgcagtggctcacacctgtaatcccagcactttgggaggctgaggcgggtggatcacctgagatcggtagttcgagaccagcctgaccaacatggagaaaccctctactaaaaatacaaaattagtcaagcgtggtggtgcatgcctgtaatctcagctactcgggaggctaaggcaggagaatcactagaacctgggagatggagattgcggtgagctgagattgcgccatcgcactccagcctggacaacaagagcgaaactccgtctcaaaaaaaaaaaaaaaaaatatatatatatatatataattaaaataccaatctaacagcaacaacaatatgttttgatgctcaagaacatgtccaggacaaagcctgcaggacacaaggtccctgtgccacctgcatctgtcactgcatcattggttctcatgacatgttccagcctcaactgatgccactatacttaattggcacagtttaaaattataaaatattagtagtaaaagggaccttagtgaccatctaggcttatttcttcatttcagaatctagcctagagattaaaatgttggtttttatccccataattaatttgttgaatcgtcaagaccagaatgaatgaaagtcatttaccttccagtcctatattctttagctacaccacactgtctgccatccatatggaatttgtcctatacccacccaaattcttactgcttcgtctcagaaagtcttgccttcaccatggaactcttctaaccactgtctctattgatctcactcttctttgagctcctacaacactcacaggctaagccacaattgtcctatcaattactttattgcttctcgtagggaactctcccaagtacacagtaggtcacttgaagatagagactgatcctcaatagtattcttgtgatcctagcttctgtcgggcacagtcaaggcagccctaaatacctgctcagtggctgaatcatcatttaatgtaacctcacctccatttactatattgggtatatcaaatacttgctattacatgaaaaagccatacctgtcttcaaactggcacacctgctttacacagggcagccaatttgtgctttaaaattctaaataaatttagctcaggtgaagataaggaaaaagagtaaggtgtgattcagttgctttttttcacatatttgtttctcagtttttgtgtgtagaccttggataaggcatttaccttcactgaatcttgaactcacctttactataagggtaatattatctactttacaagtacacatgcttattgtgaagattaaagaaaattgtgaatggcaagagcatatcacactaatgcccatgttttccatcctactgctctagcctctaaaacccaaatccatcctttgtctcattctgctaaatcctgggaaggtgctagcagatatctaaggagttggttaaaacagacttaaggtgagactcctccctaagacagttttttcatggacacaggaagaggaacatcacactctggggactgttgtggggtggggggagggggaagggatagcattgggagatatacctaatgctagatgacgagttagtgggtgcagcacaccagcatggcacatgtatacgtatgtaactaacctgcacaatgtgcacatgtaccctaaaacttaaagtataataattaaaaaaaaattaaaacaaaacaaaacaaacaaaaaaaaacaaacaaaaggcagtgtttttaacaaaaggcttcttcgaacctcaaaggattgctgttctcacagattaggacaggcactggggaagagggccctgctggtgcctcaagtcatccccagaagcagtagcctcggagtgtcttggtaagtggatgcggctgggaacagaagtgcatgcagctgggactagaagccctgtgctctagtttcagctcttgctacattttaagttgctcttcttaaaaatgagggcaatgacactttgggaggccgaggcaggtagatcacaaggtcaggagactgagaccatcctggccaacatgggagaaacccagtctctactaaaaaataaaaaaaaaagaaaattagcccggtgtggtggcacgtgcctgtagtctcagctactcgggaggctgaggcaggggaatcacttgaactcgggaggtggaggttgcagtgagccgagatcgtgccattgcactccagcctgggcgacagggtgagactctgtctcaaaaaaaaaaaaaaaaaaaaatgagggcaatgatttagatagtcaccccaatcattccagccctactatcatattctaccccttcataccaagaagacagatgctaaataaggatcaggagccataatgttaattttaaccaaaaaacccatatatattcatctggtgatactagagctgaagaaaaccatgatgattagtaaagcaagaaataaaaaatgtatttccccggattttttatggttggttgtagatagaaaaatgggggaaatttgctgattgagattaaaataataataaatatgtattacatatatactttgtgagtggcccaggaaaaacagattttttgtttgttcattttttaagaacaggtagaaaaaaggatttttttaagtgaaatgaaatttttatcaacaggaagacacaactcatatgtatgtcctcaaagtctcaatttcagaccctcacatgaaaggctgggactgttccaccctaccccattccccattcccccttgcaaggtcttggcgattcacagtgtgccaggcaaggaagagaagaaggcctctctgtatgggtcccaaatactgcagaggctacagaagagatccatgtctctacagctaatacgccattgttgcagttcttaaaataggtagggtcccatttcagctggtggggaccaaggcattctgtgacatttggatgagaattgcaaagtatctcactgtcaatcaagtaaaggaatatttcatcttcatagcatcatatccaaggcagcaacagctttcaagaaaaaagatgccagaagttcatgggcactatcaacaatctcaataagcctcatgagaaagttgtttcacctgtccttaatgcacagttatgtgggaagagagatttgtttgtgagctttgaagcaaaatggaaaattagcttaacctctgcatcaatagttcagaattgtggccacatctcacattgttactattgttcgtagcaacataattataaaatcgcagagtttaaaattttgtgaagactccctaagtgtttatttcccaatttctaaacagagatactgcacttcttcaaaagagtcatggttacgggtagtctctgcttttggtgtttctacctgcatttcactaagaaaatatcacaatacctcatctatttaaaatattatcagccaggcgtggtgattcatgcctgtaattccagcactttgggaggccgaggcgggtggatcacgaggtcaggagttcgagagcagcctggccaacatggtgaaacgccgtctctactaaaaatacaaaaattagccaggcatggtggcggacacctgtaatcccagctactctggaggctagggcaagagaatcccttcaaaccagaaggctgaggttgcagtgagccgagatcacaccactgcactccagcctgggcgaaagagcaaaactctgtctcaaaacaaaacaaacaaacaaaaacaaaaattagccgggcatggtggcatgtacctgtaatcccagctactcaggaggctgaggcaggagaattgcttgaaaccggaaggtagaggttgcagtgacccgagatctcgccactgcaccccagcctgggtgacagagccagactccatctcaaaagaaaaatatatatatatataaaataaaatattatcaatagcttataatgggcacacttcctacaactccatcaatctgctttcagccaacagccctgtctctggggaacatgtagtgcccggttaggaacttatattttgaactgcagtcgctccaaagggtacaactatagcatggtggataaaaccaacagggctcgtctctggagcttctctggcttattttggcaacaggtggacctgtgtggaaaccagtacttattgcattcattattcagcaggcatttatttacagggtgcctggcatatgcaaagtactaaggttatagcagataataaatgataaatgtatgaggtgacagacatgctaagtaccctgacttgatcattatacacaatttatatgcatgaaaacatcaaattggatcccataaatatgtacaattacaatgtgtcaactttaaaaataatcaaatttttaaaaaagagtccaaaatgccggcctcatgaaccttacatttaccaaattgttgcatatcctgacattgcaaactctggggaccagaaagagggaaccaggcctgggtgctcttatatccctggaaacacagcaggaactactcagaagtcacagaacttcatgccagtgattattcaaataaatggcgcctctgtggttttaaatagaaggtagggaaatcactgtcatttccaaattataagaaataattgataatccagaagttgttcatgttgcttaatagtaaccaccgtgcaccaccctgacttactagagctcttaaaacctcatccagtatatagcactattcactgagcaattaatattctaacttatgtttgagtattttttaaatttccaaataatttgaacaaatttctcacaagaacatatctccttttaaaaatatgacattaggccaggcgcagtgactcatgcctgtaattccagcactttgggaggccaaggtgggcagataatttgaggtcaggagttcaagaccagcctggccaacatggtgaaagcccatctctactaaagatacaaaaattagctggctgtggtggcgtgcacctgcaatcccagctacttggaggctgaaacaggaggatcacttgaacctgggaggcggaggttgcagtgagctgagacagtgcctctgcactccagcctgggcaacagagtgagaccctgtctcaaagaaaaaaaaaagacattaattctatgtattgataaaaaaccctgaacgtcatgttttcaagaacactctttctgctcataactagctatgtgactgggctcagggcattcaataacctcagcttcctcagctatgaaatgaatgtattcaggtgaataattatgaagtctccagtaagctacatgatcttttaatgctaaatagatcagtgcagttggtgtggattgactctgccccatgatgcagtaagagatagaaggctaaatgcagtggttggagcagaaaaggaagagacagacataaacacaccaacaggtcaggagatagagggaggacctgtggtatgaaggcctaaaatgaagcctcaatatgatatgtgccttgacatcttggaaaaaacaggagatcctccagcggcctaactgcaagtttccccctccatggggctcccatagatcctggagccaaacaaccctccttattaagaagtgcaggcccagtttctgcttttctctgagtggcggccttcagttcccttccagcccatggagttattcaaataagccagtcacattctcccatggaaccagggttcaacctcttgttactacaaagcctacctcccacatcccctgattgttcaccgtgttcccaagtgcagcctttgtgtggctgttcctgcagtggcctcctcctgtaggctgtgaatgtatgtgattaataaactgctgtcaatgttatctgtccagcggcaggtgccatttactcggccatctccataatccctccctccttcaaccaatgggatgcagagaaggcaatcaaaacaaacttgttcatgggtcaacttgacacacgcagttgattctgagtatatagaaaataataaggtaaatggcctccaagtgagtgcaaggcaacagagagaccaagaagatacagaggaaggtttttctgtaggcaggtggaggacagccacaggaggtgtaggtagccagaggcagtcttatgagatccacatctaaccacaggatgcagcctccaggcaagacggctggggctggggacagggctccaaagtttacataggtcagacaagcaaactaaaggaaggagttggaccaattatccagacaaagactgagccacagagggcagatacaaatgagtcaatagatgctcaatctaaggaaaaaaacagaactttgattactcagattgaatcatgggataaaatattagcagccaagtcaccctgatctcaagttactgcccttttcctcgtccttttttttttttttttttttttttttagacagagttttgctcttgttgcccaggctggaatgcaacggcgcaatctcggctcaacgcaacctccgcctcccgggttcaagcaattctcctgcctcagcctcccgagtagctgggattacaggcatataccaccatgcccagctaattttgtatttttagtagagatggggtttctccatgttggtcaggctggtctcgaactcccgacctcaggtgatccacctacctcggcctcccaaagtgctgggattacaggcataagccaccgcgcctggcctccctgctttttagcattcaagacagacttgtttccagaggctgaatagagctgatctgtccaggaagttttagaagagctcaaggggaattgtgagtcacaaaaaaatcagaacgagggccacttgccattttcatctcattttaatcatgttatttttccaaggattaacaccaaattttcaagactgttattcacctatttttaaaactattttgcagcttctatgtgtagctctggcatcatgccaggtttttgtgattttcaaaataattgggtgcctcattaaatctgttagctaacccccctaagatcatggagttcggtattgccaagatcacacacttattccattctttaatttttgaaagtggcttttatcaggattatcttggttccataattggctaaatctctccattctatttcctttaatttaaaatctctatccagttcttagtctctatagaacacattcactgcttgagcttttccatttggggccaggcctattccacttgtattacctttcctcaatgtattttataaagatttctgggaggtcttccgtagtcttccacactttgtaggactaagatccatatttgaaatattcattcattcaactaacatttacttgtggcacacctaaaacttgctaagcattggatagaaacttcaggaacctagtgaagaatgcagttttattttacagagtgtaaattttccttttggatacaaaaatgtgacaaaaaaatcaaggcaaattctttttcttcctttccctaaaacctcctcggattctggatctaggattgtacttacaagaccaatcctataattcagacatttggcctctgtatgtaccgtgattaagcaagtaaagtctgggtctgcccgagttaaaaccagtgctttactagtcctacaaatccggaaatcattcagattcatttttctttcctggagacctctgccttctaaccacaggtggtctgtacctgtcctcagatgtgccgtgagattgggtgtcttacttcaggatcctagctccgtctctctcagtttctcccacttcccagcgtcttcctcaaaaaaggatgcatacaaggtagatttaggtgctcctggctgcctgagatgtctttgttccttcctcaccttgcatggaggggtctgagtaagtgtagaatcctactttagatgactgcacctgattactcctttgctcttcaggactccgaagggactactccgttgccttctagggtaccaggatgctgcagagaagctggagcccattcctatttccagtgctttgtttggacttattttttctcttcgatgttctaaaaattcacaataatttgcctttttttctctctctttcaatttttggggctggctacttggcagacctttccctctggaagtgcatattctttggtttgaggaattattcttgcattgtttccactgatttctcccccttattatctctctctatacgtagaacttccagtgatcacatgctagagccccccattttcacatcttttctctactctcatcaatttctttgccttttattttactctccaggcaatttcaactttattgttaaattcttctatgtatttttttagcacacatatttttaatttcacatagcactatcctgtcctctgatttctctctttagcatagaatcaatggaatcttccgttatctctccaaggatattaactacgaggtttttgaagcattctttttttctatactttttaatttccctgtttacacttctgaaaatttaacttcagttggtttattttagaatatgcctttccttttagaggttgttctaaaatgtctgattctagaatgtttctaaaacatttgtatttcttgtcattcgtgtttaaaacaaagccattaaaaagctgaccggaccgttgagcacactaggggtcttgctagctggtggaccttaaggttggatgactgggcagtgagagcttttttattgggacacacccaaagtcactgtctagaggacttttctgctttctggtggaaaagaactgcccaagcccacctgccattcagcattctgggagcagagccaggaagagagctgaggcttccataattcagtgcgtagacttcagcttcctctcctgcattcagccctgtctgtctcttcaccctagaacagggtttctcaacctcggcactattggcatcctgggctctagccctgtgggagactgttcggtgcatcgtaggacgtttagcagatctctggcctctacccactacacgccaggagcaccccccaagttgtgccaatgaaaaatgtctctagatatgggccaatgttccctggggtgggctactgccctgcagggtgcttgggctccctgaggtctgagttcttccaactgtttctccagttacaaagttctaaactcttctagaagcaaagggtaggtgtggtttcctgaagctaggagatacgagagggaaagtggggatgtaaatgccacatgtgaagattttcttgcaattttgcctcgtgttatccttgctctctgtggtatctagagcccccagtcatgtgtcattatgggactctaacagttgctgctcaatgatacctgcagacactgagttcagctttgtccctccgctggatcagtctccactcctccaacccctacatattccaaaaatgtgtggacacctctagcccactcctgactcctcacctcttcactattgaccttgtcttttctgtcttttactggcatttacatggacttgtggaagggggcagagagaagccacatgcccaatgccccatgtttaactagaaacctgtactgttactttacaaatgtgattcctcatttattggtttagtacgtgcataatgaatttcttcagtagttattctagagattctgattaattatacagagtgatattgatcacttatatcattttttcttttcccaactcagatcaactatctcatgctcccagattagttttaacagtttaagaagtatggaagagttgacagactcgtgggtctctttttaaaaaaatctcttttgtaaccagcctagacgccttggctgaacacgataggagggctgtggaggtggcataagctctagtccaaggctcccttttgtggaaacgtgggtagacgcctcctggcggatgcctacagcaatacctggagcatgccagcaagtaaaaataaacctggaagagcactgggttcaagcccacgttccgtccatcccagagggccctcgagcaaggcctcctgcccaatcacatgtttttatcataatagattcttccaggtggtaagagcagtaatacaatcatcacacagtttgccaaagcattttccaagaataactgccagaagtgtgcattcagcttgtgtgtccatatgctcctggtaagatttagaaagcagggaaaagggatgagaaaagattaagtcaggaaaattgaaaaagaaggagacaaattgaaaagggaagaaatcgaaaaagaaagaaaggtgattccactgatgagtgggcgatctgctactctttgaaccataaatacatttcctctaactaaatgcatcataggtattctcaattcgatgtattggttttccacaacctaatctatgaattttcaagtgtaattgtacactgctgtctgaacaacacaagagcaagtccttcagcattgtacatagtgtagccatttaggactgtgcactcaaaattggttggcaaacatagggcattatgaggctgaaataactgtagctcactcttcctgaacctcattacttttggcagtgcctctactggtaagtgaaatgagttggatagcacaggagcagatatatgtttttaagaataaactcagggaccttgagtatcacaaaatcttagttaatccacctcttttcctttagaactctgcttcagcctcacccctctgaaagacctggtgccagctctgcccgcctccactggctccatttatcaatgctggcccctgcatccctgatcctctcactaatcctaagcttagagtggcttttcctctcccatggggccaattcctattgaacttcagttagtccaggtggagtggggctctcggtctaggatacaagcaagctcatgcccttggtctgactaacactatattttaaaattggacccaagaaccaatagaaatacattccttccatttaccttgggatgcagaaatactctcttttaatgatcttgaggtcattttgttccttgcattgcaaatcctacaaggataaaacttttatcttaaatctacttacttaaacttctttttttaacaagacaaaatttaagccatattcccatggctgacacaaaaactgaagcggttttctccatcctgatgtccttggaaattgtacttgtaattcagagatcaagtatctgtcttcgtttaaagaaaataagcaccaactggagctctagtaagttttcttttctctctccaggggaggttgttgccctatgtcatgagaaacacagaggacctgacatgtagaatgactatgaagcagtgttcatagaaataaacccccccccctttttttttttcttgagacggagtctcgctctgtcgcccaggctggagtccagttggcgccatcttggttcactgcaagttccgcctcccgggttcacaccattctcctgcctcagcctccccagtagctggggctacaggagcccaccaccacgcccgctaattttttgtatttttagtagagatggggtttcaccgtgttagccaggatggtctcaatctcctgacctcgtgatccgcccgtctcagcctcccaaagtgctgggattccaggtcccatcccttttaatttctgcacgggccctactttaagtatcgctgcagtggcgaaagcattcatcattgccgacctgtgtggaatgtgaacctgagtattttctattggcgggaacttacgtggctaaaacgtctcctttataatgtggagctaaacagttcaaaatcttgaacagatcttatcacccttaaagtattatgtaatatgatcctcacccaagaatgacctccaagtttcctgacatacttgacgggggagactggtgtcacatgaggaccagtaaaaaatctgtactgaactgaaatttttatgcctcaacatttttttacaaaaggaaatcaaatgtgaaaatttatctggatgctccatacttcaaacaattcccattaaatgcattaaggctttccagtggcctcccatagcaggattcctccaacacttctgtgacggttcattttacatgtcaacttgactgtttcacaggagtgcccaggtatctggttaaacattatttttgggtgtgtctgtgagaggctttctggaagaaattagcatttgaatggtggactgagtaaagcagactgcccatcccactgtgggtgtggcttatccaacctgttgagggcctgaacagaacagaaaggtggaagaagtaaggattctctctctgctggagtgcttgagctaggacattggccttggagtgggatttacaccagcatcatttctggttctcaggactctggaatcagactaattacaccaccaacttccctggcctccagcttgcagatagcagattatgggacttaacctccacaatcacacaagccaaatctttataacgtgtgtgtgtgtgtgtgtgtgtgtgtgtgtgtgtgtgtgtgtgtgtgtagacacactattggttctgtttctctggagaaccctgactactagaatttctttttttttttttttatttttattttttgagatggagtctcactctgtcgcacaggctggagtgcagtggcgcaatctcagctcactgcaacctccgcctcccgggttcacgccattctcctgcctcagccttccaagtagctgggactacaggcacccgccaccacgcctggctaattttttgtatttttagtagagatggggtttcaccgtgttagccagggtggtcttgatctcctgacctcgtgatccacccacctcggcctcccaaagtgctgggattacaggcgtgagccactgtgcccggcctgactactagaatttcttataatggcctacccaaggtcacatatgatctcactcctgcagacctccccaaattatttcctacagcttccccctccccagcttcctgctgtcctcaaacatgccaggattactaccaatttagggcttttacacttgtttcttaagcctagagtgccttcaactatattttgtcatggcttttgatttctgctcaaattatggcatctcatatgtgctttccttgaacagccaatctgaaaagaagttcctagccccatctgtatccaggctccctctagctgtttttccagtggttgaggtctttaagtttaatatctctccaaatatttctttcttctcaactcccattttcctctcttctagactccagttacctgtgattagataatttgatattatccacaggtctcaagtagcctttttcattttttcactcttttcctctctattttgcaaattggataatttctattcacttgttcaaatttactaatcccttcctctgctatgccatgtttgctattaaacccatcaaaaaaattctccatttctgatattgtacttttttttccagcacagctgtttgattctctatcatttctatctctctaagatttcctttactttttcactttttcattgtccatttttctgctgatctttaacatatatacatatgtatgtgtgtgtgtctgtgtgtgtgtaatctgtccaataattccatctggtccattccttggtctgcttctgttgactattttctctcttgactttatgtttcttcacataattcatcaatttttattgtggttcagatattataggtaaagtattattacagactaaagtaaataataatgaacccccccccccaaaggatacactccttcttctctcaaggctgagttagctaatctgcagctgagatgtgtctgaacttagtctagctttagttagattcagttgaccactaactataagtttgaagacatgataggactttctctttagcaagattgggtatctgcacattgtcaagactctgaaaatattgttctccttaacagcccagccaccaaacttctaagctctggaaatctctatctacttgtcagtccatctgttagcttttttttttgagggagatggagttctcagggaattgttttttgttcatttgtttgttttgtttgtttgcttggttttggtctagtaccacttctagctttgtgtgcctccaagtagtgctctctcttagcattactgtctgactgccagcctttagggtctctatggtgtgttctgtgaagaccaatattactttggtggaattattctcagctttcctgcccaactctagccctcataggacttctgcagtgtacttggtgaggcctaaagtgcctcaaagggatttctttcctctctcctgctctacccctagacttcagcagccctctgccttgtccttaaaaaaagtccctcatatctcagggtaaattagttcagcaaagctgctctgattccatcatttggcactgtaccctgtgcatttagtgaaggtccctggaaaagagtgggcagacagatgcagacttttgtgtctggagctccttgagattctaatccttcctgccagctcatatgcagccaccaaaagttgggctggtttctcttctcctattagtccaccaagaataaaagcaactgtggatctcttctctcatggaaatgtcttgccactttctggaaattagttaattgtctctttttgcatactcagctctgatgggtttgagatgttacaatgctgtagagtgtctggcttgatattaaggttagagtggaagtgatagtctcttgtacttcctacatctatccagatagaaaagttcccaccacatctttgtcatctttatattttcagcatttgtactggtactagtacttggtagtcactcaataaattttttgttggatatgtaaaaagagaacagtgatattaactagacacctaattggtagtattaaccagacacctaactggtaaaagattagttaaacctaaatatgcccagaattttttgaagaggcaaagattatacaaataaaagaatttttaaagtaatttatagtaatgctgccactctaacacaactatgtacatggaactaatattatttattacgatcttataacactgatgcctatctgaattgtgcagatgaagaaaaataatataatctatgcagatataattatgacattagctgaggcaggaaaagtaaactctaatgtatttaagtggaaaacacacaaattaagttaaaacaaatttttaatggaagagtagaactggttcactattcacgacttttccaggtttaaaatgaatacaattatattactagtaaaacctcattacggcccatggaaatgccctgtggttacactcagtgtttcctcccaatctcatgattgactatggaaaactgcaaatctaggttttccctggttcatatcagcctgagaaattagactgaattatctgtaacatctcccttttaaacatgtgctttcagataacatcacgaccagagtactgacgagatatttccttatccaggacggactgattattcaaattaactttggtagagtaaacatgattctatattatctgaatagctacttggtttaactgacagaaatgaggaacagggtcagaacagtcagtgtactataagtgcacttatggcatcaaataccacaagcaagccaaggctggttcagcaaagcaattttggagacatccctccccataaagcctgaatatagctggcccctgttcagctctggttgggggaaaagtggattattaagaaaacacttcagatgtggccacagccacatattaatagccacagtccagcaataatgctttgacctgaggctgataaaacatggtggagtacctactaatttagattatgagctaagaaagttgtctattttttcactccgaggaaaggtaatatttagtaggaacagtttgtgcaatgagtcattttcatccataaaaatatacactatagcacacccctaacaggatacttgtttagacgttcttagacttggtcgccttggcttccttttggcatcctatggtaggatcctatgacttgattctttagaatcctctatggtaggaaacgttggtgacccttgaggccgtccttctctctctcatagcaattaagatcaactggtagatctttactagtggactcagatgggaaaacaggagttaagggcaggcaggatatttattcatataagcatgtcaaggaacttctttttctaatgattccacagagccctattttgaacaacagctgggagagaatcaagcaagctcttttaacaaggcaggctgcaagcattgccattccaggagacagtttagatgcaactattcactcatctctaaccatcacttgcgtgaacattactcaaagagatacagcaaccaaagaaatcaaaccagtaaaagaaaggtttatttgtttaatagaggtctggcagctgaggcaaaacctaacaataattctgatgaagactcagtcatttatttggagcttctaatgaatctaactaggtaccttatacaggcttgcgtgggttaaatcacagctgtaaagtgccatgctaacagatgagagagtatgtgattgtatcagagatactagggcatccaattatatttatcacctgcctcctattaaagcttttttctgttcttaacgtttgtgttggtagtggcaacatagaggttacagtgagctttgtcctaaagaacctggaaataactgaagtatgagtcagactttaggagatcagctcagaatggatcagagctcagaggaaccttgggacctcattcgtccaatgtcctaatacagatcaacgatcaaaacagtctatcaagggttcagcctaaacacaattaacatggagcaactcttgccattagtatatttagctctcgataaagcctgagaggttaatatgattctagacaaccattcataggcagagatatatcttcctagccaaaaagaaaaaatatagttcttaaagaagagtaggaaatggcttagaagtgatagttttatttccaattctcaattccctgtctcattttgctaaatgggtttaaggagcaacgatgacaatctgctacgatttgcatactcaagcaacactatgaatcactgcaagcatcctcttttgttgcttcattttagcttagtcaacgtccagacaatcagggtgtattgagcatcttctctgataaaagtattttgaagaaaaacaaaagaatggaatgttccttctctcccaagggacttaaaatgtactacctggcatacaagtatttacatcttaaaatgaaaagcagtgaataaaatcatagaccaaaactaatggtgaatttccagcctccagtaaagaatttttcttgaataaacaagtctattttatttcttttcgttctttttaattttaatagtacaggcgacagttaaaaataaaagagagagagaaaggaagagagaaaaaaatggattgattgattcaggtatccttcgtacctctgcccagagacaatgtccatcgtcagcttttaaaatgcatcctaagatgtgcatacaaaatagcatcctactgttttttacttaaaatatatctttacttaaaatacattccagatcactcctgttagcgttgctacatttttaaaatagctatgtactctcctattgtatgcattgctccaatttcttctatttctgctctacataattctcttgaaagaccaaaggctgggctcatctttttcgtcttgttatgcccaatgaattattttttcaatttttgaagtcaaataagtttaccgcaatatatatctgtattttgatctttatgtaaacattagtttggcactcacaatcaagcatgcaggccaggcgtggtggctcacgcctgtaatcccagcactttgggaggccgaggcgggcggatcacgtggtcaggagatcgagaccatcctggctaacatggtgaaaccctgtctctactaaaaatacaaaaaattagccgggcgtagtgatgggcgcctgtagtcccagctactcaggaggctgtggcaggagaatggtgtgaacccaggaggtggagcttgcagtcagccgagatcacgccactgcactccagcctgggcgataaaacgagactccatctcaaaaaaaaaaaaaaatcaagcatgcactttgaacaagccagggtgtaagcattgccatcccaggggatattttagctgtgacttttcactcgtctctaaccatcacttgtgcgtacattactcaaagagatacagcaacagaagaaatcaaaccagtagaagaaagatgcatttgtttagtagaggtctagtagctgaggcaaaacctaccaataattctgaaagagacttagtcatttatttgaaaccttttatgaatcttctggttctgtaaagttttactgagttgcatctttagtttttctccattttgttatttgattctcttcttcaggaatagcaaatatctgtttgtcgattcactttgtcttccatatttaccattgaaaaactcattttaactctttgctcatgttgtctttgttttgcccgctgttctcagtgccgtcacagcgatgcttcctgccatattttcaataatctttaatttcccttgggttatttccaaacaggactttatatttgatgttcgtatttttttcttctacttattgcctgagcttgatcagctcatgtttaatcttcttccattgcttcaccacatttttcatgacctcttatattcatggcttaagtttttgttttctggaaattattgctttctttaaaaaatgaacataagccagtattttaaacacagatattttgcattgggaagattttttagatgcacgttttctatctgccatttatttttgttttttctaatctattctacattacttccctgcaggacctgttctttgttctcctcaccctaccccaccactcaatttatcacttgtctttgcacgaagtgagttgtttcaggcgcagccattgttgttgttagtgaggttctttgcggtgcagagttgggtgaaggcagctacaggaggctcaagggcagatcctccttcaccacagagctcacaactatggcaatggctgtgtcctttctcattcacccaaacccactgagtatcccttttccaccagcccacacacctcaccactgctcccaacaatgggtggttgttttgcccctcctgttgcgccgctagcattgaagatctacgttctgttggctttgtctacgaactgccacgtggcgcatcctgactcggcatctctgcacacctccttttgacttctttcactgcacttgtccactcctgttcagacactgacatttaggatggcacacaccttctagttccactgaaaataaatcttatgtttcctgtttctaatctccttattttctggagaaaagaatggaagcaggatccctttactccaccataaaaggaacacatacccacaactattcatttggggacttccaaccatatacacaccttccccatagttaagtgccactttaagtggttccttcgccattgaagacaatgtgaaaggcagtgtgaaaggcagcaagatctcataaattcttcataacatatataatatatataatataacatataactttataatgtaacataatataattacatagtaatacactggagaacacggaaaagaattaggaaaaaagattttactcctttcagtatccaagagagctcacagagcatcattcaggactcagaaagaggggcagagctcagttacagtgaagaatgggttccccttgattttcctactgtttctatgttctttgagggaaagtaaagaacaaacgtattttgtgtaaacatgctcagtgttgaaattgtatgacaaaaatagtcttctaacaaagataataataacatctgctgagcacttagctatgtatcatgtacctatgtcctatatattttttgtattaaaactttattgtgacataaccatagattggcatgcagctataagatatgatacagagggagcatttgtactctagccaacctcttccaatgctaacatcttgcaaaagtatagtaaaatatcacaaccaggatgctgaaattggcatagtgaagagaatttttccattactacaaagatcccatttattgccttttttatcaccttactcaccttcctctacttcatcccctacatcagtcctaaaaaccactaatctgctttctgtttctataattttgaaatttcaggaattttacacaaatatagaattatatgatatgtaaacttctgagattagttttttcactcagcccaactttctagagattcacccaggctgctgtgtgtatcaacagtttatccctttttatagctagtggtattctatgggaaggaggtaccacagtgtatttaaccaatcccctgtggaagaacatcttaattctttccagtttggggttttttgtgggttgagttgtgcaccaagaatttacacggtgaagttctgattcccagtttctctgagagatcacctcagaacaagatcttacttggaaatagagttgttgcttgtatcattagttgagataatgtcatactgtagttgggtgggcctctaatccaatgtgactggtgtccatataaaaaggggaaatttggacacaggtgggcacacagggaaaatgtcatatgaaaatgaaggcagagatcatggtgatgcacctacaagccaaggaatgcccgtgattgccggatccctccagaggccagaagaggggaatggaacacattcttcctcatggcctgctgatacctcaatctcaggtttctagtctccaaaactatgaggcaatacatttctgttaattaagccacccagtctgctgtactttgtttaagtagttctagcaaatgaacacagaactactgccagtaaagctgccacacatttgtgtacaagtttttggtctttgttttttgagacagggtcttgctctgtcacgtagactgcagtgcagtggtgcaatcacagctcactgcagcctggacctcccatgctaaagcaatcctcctgcctcagcctcctgagtagctgggactacaggtgtacatcaccatgctcggctatttttgtttgtttgtttgatagagacaggatttcactgtgttgcccaggctggtctggaactcctgggctcaaggaatcttcctgcctcagcttcccaaagtgctgggagggattacaagcataagccactgcacctggcatgtgtgcaagactttttgtggatatatgtcttcagttctctgggctaaatgcctaaaggacaaaatgatagttgcaagtttacttttgtaagaaactgccaaactacagctgactcttgaaacacaaggtttttaactattcaggtccatttatatgcagattttttcaataaatatactacaaagtttgttagagatctgtgacaatttcaaagctcacagatgaaccacatagtctagaaatataaaaaaaaataagaaaaagttaggtatgccataaatgcataaaatatatgtagatactagtctactttaacacttactaccataaaatatacacaagtctattaaaaagttgaaatttatcaaaatttgcccacacaaacacttacagatggtacgtggcaccattttcagtcaaaagaaatgtaaacaaacttaaagatgcagtattaaattataattgcataaaatcaactgtactccatactgtactgctgtgataattttgtagccaccttctgttgctattgtggtgagctcaagtgttgtgagtatccacttaaaacgctctttgtccccacacagccagttcgtctctccagtaaattgcctatcacagcaaaaagtgatagtttctggttcttgggtatttttcatcatgtttagtgcaaaccgtaaacgctgaataacaccatgggacccacatgaaatatcactagtgatgccagaagtgctcccaagaagcagagaaaagtcatgtgagttgcttgatatgtaccatagattgaggcctgcagctgcagttgccaaccatttcaaacagacaattcatcttgtaaacagacaacataaacttaaggcattgatatatacagcatggcactgtaaatgtactttttcttaagattttcttagtaacatttccttttctctagcttactttatcataagaatataatatgtattatatatacaaaatatgctttaatcaactatttatgttatgaattgcattcaacttacatgtcagcttggcaagaattgacatcgttactatgttctcaaccaatccacgaacatggcatgtctctccatatatttagttaaacgttcaactacttatgttatcagtaaaacttctggtctattagtagttaagttttgtgagagtcaatagctgtactcatattttcttttgttttccctcaaggagtacatgtgcaagtctgttacatcgataaattatgtgtgctgaggtttggtgtacaaatgatcctgtcacccgagtagtgagcacagtaccctgtaagtaggttttcagtccttgtctctctcccatcctcctcccctaggagtccccagtgcccagtgtctatcattcccatctttatgcccatgcatacaccatgtttagctcccacttataaaggagaatatgcagtattttcttttctgttcctgtattaatttgcttaggataatggcctccagctgcatccatgttgctaaaaaagacaattgtaagtggtatgtatctttaattttggtgtcctcacattcattactataatatagaaataaaattgatttttggatgtgtatcttgggtttcttctttgggttccgtgaccttgctggactcattcgttagttctaagagtttttatgtatatttcttggaattttctacatagacaatcacgtcatctgcaaataaggatctcttcctttctgatcgaaatgtcctttctttttcttatcttattgcactggctaaaacctcaagcactctgttgaataaaagtggtaaggatagacatagttgccttgttcccaacattaggggaaaagcattcagtctttcaccattaataataatgctagctgtagggtttctgtaaatgtcctttattaagttgaagaagttcacttctattcctagtttcttgagagttttttatcataaatgggtgttaaattttgtcacatgcttcttttgtatagattgatagaatcacgagctttttcctctttagctttctaaacaactcctttgtttcctttaactaatatgtgtataaaatttcattttccatccttcacctcctatctgcttatcattatatttgaagtcggttctttatagaagtaatactgttgctttagtttttacattatatgtacataatttatgacaatctactagtgtcatcattttaccagtttgagtgaagtacagaaatcttacctcccttcatgtccttttatcctgtcctttttataaaaagctgtcttaaatatgtcctttatatatatttagagccacatcagacagtgctgtagtttttgcttcaactgtcaaacatatgtagaaaactcaagaggagaaggaaaggttattgtatttaacaatactttcacttactatagtctttgctcctttttcatgttccaaggttctgtcttctatcacttcctttctgtttagagaatttcattcagccattctcttacagcaggtctgctggcagtatattctattagttttcctccatttgagaatgtcttgattcctccttcattcctgaataatatttttgctggatatagtgttctgagttgtcaattcttttcttttagcacttaaaaaatgtgtcatttccttctggcttccaatgtttctgatgaaaaatctaatttttcccccagtaggtaagatgtcactttttaatgaaaatttttaagattttttctttaatattcataagtttaattatggtttgtttgacatcaatttctttgggtttcttctgtgtgaagttcactcagcttcttgaatctgtaggtttaagtcttttgccaaattcgtgaatttttcagtcattatttctttgagtgtttttctatccaacctctttattttcctccttacaggactctaatgacataaatgttagatctttaattgtagtcccacagatctctaagtcttcctatttaatttcagtctatttcctatttttcagattgggtaacttctattgttctatcttccagttcaccaattctttcctgtgccttcttcattccactgatgagccaatccactgagcttttctttggttattgtattttttagtccttagacttacatttggttcttttttgtaccttatatttctttgataagactttgtatttatttactgaggctttctattttctcatttgtttcaagtgtgtttgcattgcttattgaatcatttttttcatggctcctttaaaatctttgtcagataattttagcatctttgttaccttggtgttggcatctattgatggtcttttctcattctttttgagatctttcttgtcctccatataagtgattttcagttgaaacccagaatttttctggtcatatgttatgaaactttgaaacttatttgaaccttatgtattagttggcttttctaatacttctttggcagggaagagaagaggaaccaccccatgactaccagttggaggtagaagtctagttttgcaacatggcctccaatgccacctaggggtggggggagtgtttggcagggggggttgttctggttccctacctggtgttcaatgataccagagtggtgatgtcctccttaacctggcaataaagtcctgactctccactaagtaacaccccaggaacaatggtgaaagtcctgacttttctctgacaaggagagagaatggggcaccttgctactgtcaggtggagattcaagtccagctatccacatggtctctactgacattgtggtggaaagtgaaggaagtctcaatgccagtgacaggaacaaaagtcccagctccctacttggcctctctgacatcaccctagtgagagtgctggggaaccccattatagcttgtgaaggtagaagtctagcctccccactcagcctttgctgatatgggtgggagtgatgctacagttttttctgtagtgtttggctggagtaaagtggttattatccaaaagtttctgtctttctttgtttttttttgtttgtttgtttttgtttttgagatggagtctccctctgtcgcccaggctggagtgcagtggcacgatctcagctcagtgcaagctccgcctcccgggttcacatcattctcctgcctcagcctcccaagtagctgagactacaggcacccaccacaatgcccagctaattttttatatttttagtagagacggggtttcaccatatttgccaggatggtctcgatctcctgacttcgtgatccacccgcctcagcctcccaaagtgctgggattacaggtgtgagccaccgcgcccggccaagtatctgtctttctatgctgccctttttccagggctttgactagagagaccaggcttttgttggggacttgtcttgtctgtgcccattggcattgctgggttgtgggtttcttctactccaaatatgggatatgagtggaaaaaaacacagggaactcattagcatgttattcctcatgtcctgagtccccagctaatctgccttgttctcttcttctttcatggcctccctacatttgttttatgcaatatatacagttttttattgtaattagaggatctaatagaggacgctattcctactccatcttcttggaaacaagagtctgtcttagatattttacacttactcatttaattctcacaataaccttttaaagtagtattattaaggtctcaattttacatttgaggaaactgagttacagagaagttaagtagcttgtctatggtgacatgctaacagcagcaaagccaggtttcaaacccaagaagtcagcctccagagtcagtgctttcaaacagtatactagaactgttttcaagtaataaatgttcacaacgaagctcctcatttgtcttggttggtctctccctgcagggctggactcccgattattgtacaatagttgagagtgccctctgtggaacatagtcctcaggttacacgccccatcttttccccacttcttacccacaagtatatacctagttttaaaggtgcagggttataagcataaaaatgatcagtcatgatcaatcacatcccttatttttgaaaatccatcatgagtgcgcataataacctcaaaatgagagccatgaatgtaatcatcgtccctgtgtttattaatcacatccttttgaattcaacactttttattttctgccaacttcttgctgcattatctacaaggtaatcattctttcaagggatcttctttaagtctcttccattctctcagcctttagcccaagtcacctccatcactttcaataagacttcaccaattctgtaatgttctactacatcaaaagccacagaagcattgagatggaaagagcctttagggaccattttgctggtgataagagaactaagtgacttggacaatgttacactgcttcttcgtgacaaacctgagactagaaaactactacatatgacatcctacacactgactcccttcttcagctctgtctgataaagggatgagagatcgtttcttattattacacatacacgccacttccgttccttccatctaaacctagttcagaaacaccgctaagaattcccacccccaaaaaaatggggatgggggaagagaaggaagtgaacagtggtgtcatcccaccaacaagcctgactgcacaaactatctgcctgttccataacaaagagattatatcaaacctacctccccaggaatcagtctgattcaacctcggaactcctccttctcctttccatttggcccaaactagggtttttctctcaggtcttttgggctttctgaacaagtgccagcaccctgtggcttgctgctgccagcccaactatagtaattttccagaagtctctggttatgccacactgctcaaggaagaggaatatcattaaagtgacttcacagccccataaacatgccacttgcagccctcttattctgtctggtggcctacaccacacactacaatcaacaagggacatctagatttcagggccaaatccctgcaaagactctgtctgaacatacttttgtgaaagcctgcagaatatagatttctgtgtgtcataaggaaataatcggtccttaaatctcaaagtacaactagctgcagtatttaaaaagcccatggacaatgacaaatatagacatcacaaaattattctaaactgatcaatgctgagaaaagtcatgatgtgtcaggagtctcagctccaaaggcagtctgccctttaacataatgaacttcagtaaaagtagaaaccatttctgagggtgtaattgacaagtggcaatgaggtcatcagtagagtttatgacatttaaatccctgtgatatggtttggctgtgtccccacccaaatctcatcttgaattgtagctcccataattcccatgtgttgtgggagggacccagtgggaggtgattgaatcatggaggcgggtctttcctgtgctgttcttgtgatagtgaataagtctcacgagatctgatggttttataaagcggagttcccctacacaagctctctcttgcctgctgtcacttaagacgtgactttgctcctcctttgtcttctgccatgattatgaggcttccccagccatgtggaactgtgagtcaattaaacctctttcctttataaattacccagcctcaggtatgtctttattagcagtgtgaaaacagactaacacgccctggatctacttttcccggttttatttttttgtaacccacaagctgtcctgcctcgtgtaatggtcttaggcaaaggaagacctctctggttatccttaattctatagatacctacttcacacacacacattcaaacacacacatacacacacacacacacgacagagggacttctaagtaaatatcatatacattatgaggaatcaagatcttgcccttttctaaagcaaataactgtcaggcttgggcaaatgcaggggccatattttctaatgaaaaaataaaaatatatgacactggacaaattattgaaaatggaggtatacattataacttcccttactttagcttgctgacaggtaaccttgggctctgccacaaagtaattttcccatctggactaactggggatcagacagaagattctttttctttcaaggtgtcctagaaaattggggacaccttgtagcaaatcaattaacattttatttgatgtagaaccttacgacaaatagtgagaatttccacaacacaaaaattgtgaagtttttggcaatgcataagaaatgaacattggcagatatgtttcacgtggccaagaacttgatgtttcatcagccatgaggctggtagtgtctctattttacacacgtgaaacatgggctaagtgaggtaaagcaagttgcctgagatcacgtggcttgtgatgagaagattcaggattcgactccagctctgtgctactccagagcttccgttctttctcacatatctagttcaggctccttcatctccgagtgggtatggagaccaagtatgcctgttattgttcctcagagaaggatttctggaggacatgagtagtctgaagagttcagcaagtcctccaagttccacccaaatctgataaatgtgctgaagtacggggcgctgttactatacaacatggtgagtaaagggaaccttctctctgatccccagacaccccagatggaaaaaggtgctttgctgcagagcccacggttatctgtctggaagcaaaagtaagggaggccacaaggtctacttccattttcaaactgagggcgcctaacaattgcaatcctgtaaagaaataaattcatttctggaaagttggaaattgtcttcatcgtgccctgcccaaagcctctggtcaagaaattgaggacttgcagaataggactcctcctcaaactcaagcttttgtgttccatgttcaatgagagattctggccacagaaatgttccctacctgctccagcaggaactaagccttcctggaacatgattatcacaaggatccctcccagtgaccacattttctgacatcagcctaaaccaaaacgactcgcctgctcagtgattatataaatccattcagtctctgcaaatgcccaggcttttgttaccactactgctgttttggctgtacaaggcttaaaatgcaaagtaagtcacgatactaacctttgcctccagtaaggaatgctcttcttggagcagcccccatacctgggacaatgcaagtcagcctttcaatgagatgcttagcacacaagccttctgtgatccagctcctgcctctccatcatgcctcagtgtccaacactctctcttcttcagtcaattcaaactatttgtaggtccctaagcacagtttcccctctttctgccctgcagacctgctttatctagcaaatgcccactcattattcaaatttagtgcaattatccagtcatctgggaaactccccttgatccacaaccttgatttagtggtctcccctttgtgctccctgaatagcatgtccatgcttctccgatagtgctcaccacattttatagtaacagctgatgtatctacttgtgtgccccaaccaaaaatcaggttctacatatcttgaggaagttttctcattcaattttgtatgagaatttacggaacttccaattctataacatagttgttaaataaatgcttaacgaaaaggtacacttggttcactcaccaaacaaatatttacaaaggaactacaaggtatatttagaaagcacatgagttcctgagcactgatcctaagttgaagaaaccctcctcacctcaatctcttgggcacatgagaggtctcctcacagactctcaaacaattggtgcttgaagagaggtgggaagtggtacgagggaagatggagggagagcatgactgcctgctgctacctgagtgagaagaggaaagatggagatgagggcaagcagaagcatgtggtccacagcatcacctagtgcctagtgcggaagaggaaagtcttggttccatcactcattctagcttagagtgaatcttctgttgcaaactttcttattgctctaagacagagatcatcagaattgaggcaaaggctaaagcagtactacactttctatgtcagtatttttatatactggttagtggtatacatgcatgcaaatctccctttaaattcaaatgtcatgttagaaagtagggtttatatgtacaggtgtttgtaaatgagaagtttgtaatttagggagtacatatttaatagtgcctcacccagaactgctataggcaagatgatcaggaggaaaaacagcagcagctgatgccaaaatgtgtgattcagatgatttggaaattaagagacattccaaagaacgtgtgcatatttccttcagacatagtctactagctaacagattgaatttttaaaatatatgaataacttttctgacaaaagcttaccaaaatacagcaatgacttagaaatttagcatggttatatgtgatccgtttatctctcccatcatcccactatctcagagtacaaaataaaaatcattcgtttcatttttctttatgctaagtagaaaggaaattgtgtcctgttctcatttcaagttaggttgcttcttgattaaataagagaatgaactcgcctagaataataaatgatcctctcaactgcacgttaactgaacactctagcataaattaacaaagcagagagatcaggtggaagtatagctaaaagactaaaattagtttggcatgggtttggatattagttttgtcactctgtagctatgtaagtttggacaaattaccataaactctccaaatctcaattttctcaactgtcaacagagttgacagcaaatatctcatgaaatggcgagacagatttcaaacttgtcatttacaaacacctgtaaatacgaactctactttttaatatggcattacaacttacaagatttgtatgtatgtatgcaattaaccatgatacaatggcagcataaaatggcaccggtaaagtgtcaggcacacagcctattgcagagtgaacactcacattttgtttccacgtgccccacctcttttcttgatttaaaggatttctactgggcaaatgataagagaaacaagacacttttctgtccttaaggaacttagactggtaaagaggataaaataaacacagacaaagccaggcaggatatacattttgagagcagaatgaatccaggtgatataagaacacaaaggaggaagaccatgtgccaagttccctgaggacatcaggatcaacttcatgaagagaccattttaaatgggtctcagagaattggtagggaccttgtcaatgtgtggtttttatttcctaagtaagactcacagttacaatacacatgtaaacacaggagaagacagaagttaaggcagatgatactctggtttaaaaatccttagaggaattttcactggtcaccaacttttagagctacattgaggatgacaactagggtggaaaacagtatattgtccagatatactattaatataaaatggggcaatgttgcctactgaagggaaggtaggggcaagccttatctttccctttctggctcagagaattcccagctttttttttttttttttgcttttttgagatggagttttgctcttgttgcccaggctggagtgcagtggcatgatctcggctcactgaaacctctgtgtcccaggttcaagtgattctcctgcctcagcctcccgagtagctgagactacaggtgcctgccaccacgcccggctttttgtattttttgtagagacagggttttgccatgttgggcaggctggtctcgaactcctgacctcaggtgatccacccgcctcagcctcaaagtgctgggattacaggcgtgagccaccatgcccagccagaattcccaacattttaaccaaagcactaggagctttccatctgtagtacaatcaccgaacaagccagaaactgtgtcatggcctctttaatccatactattccttctacagagactaattcccttaaaaactaagagacagatgcagccttagcctcggcctacacagggtccagatcatccatatcactgtttccacctccatgtcttgtcctactggaaggtcttcagaggcggtaatatgcatggagctgtcgtctcctgtgacaacaataccttcttctggaatacctcctgaaggaccttcctgacgctgttttataactaacttattacatacttctacttacataagtaaaaatacactctaaataatgataaaaactatagtatagtaaatacataaaccagtaacatagtcattatcattattaagtattatgtactgtatgtaattgtatgtgctacacttttattcaactagcagcttagtgcaaaataaaaagagaggactcaaaggggatcatttaggaaataaactactcccgggaaagggacacaatctcaacaagcaatagggcggcttgtgtagtgtagtgggctttggagaagatccctggtagcagtggagattgggagttgtggttttcacgtacttagtcatttagtcaaccagagagacaaatagttgggataaaagaggatctcataaatccaacagaagagtacagaacacagagcttaggctgttcacagcaccacctcctaggaaaacactgtgagcactcaggttaacagtaggtagatctgtgcacaagccatttactctactatggccaagcagcctaatctgtcgtgaacattcctcttccccccaaaaataaagaggaaataaagagaagggagaaagggagggaagaaggaaaccatgagtcttaaaaagatagcacagaaacaattattctgaaaatgtagaggaaaagtatagctctttaaaattatttacgacacaaatcagaagagttcaaataaattacaatgcattcatatattttgcagatgttcactcatgttctcaaataccattaaacgcatcagaaaatttgtagaatgtaatatgaagtgaaaagagctgggtgcaaaagctgtatatatcaactttacaaaactttgcacatgcggtacatataaagtcatcaattgcttaacaacatttcagtcaacggtggactgcagatatgacaatggtttcatgagattataatggagctgaaaatttcctatcgcctagcaacactgtagcagtcataaagttgtagcacaatgcattactcattgttgtaaacaaacacactaagctgctagttgaaaaagtgtagcacatacaattacatacagtacataatacttactaatgataatgactatgttactggtttatgtatttactatactatactttttatcattatttagagtgtatttttacttacgtaagtagaagtatataataagttaattataaaacagcttcgggaagttccttcaggaggtattccagaaggcattgttgtcataggagatgacagctccatgcctattactgcctctgaagacctttgtggaggtggaaacagtgatatggatgatcctgaccctgtgtacgctgaggctaaggctgcatttgtgtcttagtttttaataaaaaaagtttttaaagtaaaaaaaattaaagcacaaaaaggcttatagaataagaatataaaaaagaaaatatttttgtaaagaagagtcaaaaagttaagaaatttaaaaatgctcatcatcactggtcattagagaaatgcacatcaaaaccacaatgagacaccgtctcacaccagttagaatggccatcattaaaaagtctggtaacaacagatgctggcaaggctgtggagaaataggaacacgtttacagtgttggtgggagtgtaaattagttcaaccattgtggaagacagtgtggcgattcctcaaggatctagaaccagaaataccatttgacccagcaatcccattgctggatatatacctaaaggatataaatcattctactataaagacacatgcacttgtatgtttattgcagcactatttaccatagcaaacacttggaagcaacccaaatccccatcggtgatagactggataaagaaaatgtggcacatacacaccatggaatactatgcagacataaaaaagaatgagttcatgtcctttgctgggacacggatgaagctggaagccatcattctcagcaaactaccacaggaacagaaaaccaaacaccacatgttctcactcataagtaggagttgaacaatgagaacacatggacacagggaggggaacatcacacactgggacctgtcgggggtggggggcaagaacaaatacctaatgcatgggggcttaaaacctagacgatgggttgacaggtgcagcaaaccaccatggcacatgtatacttatgtaacaaacctgcacattctgcacatgtatcccagaacttaaagtaaaataaaacatacaataaaataattttaaaaaatgtaaaagtcaaaagctacagtaagctaaggttaatttattattgaagaaaaggaaattttaaaaataaatttagtatcgcctaagtgcagggtttataaagtctaccctagggtacagtaatgtcctagaccttcacattcactcactactcactcactgactcacccagagcaactcccaggcctgcaagctccattcatggcaagtgccctatatgggtgtaccatttttttcctcttctataccatatttttactgtaccttttctatgtttggatacacaaatacttaccatggtgttacaactgcctatagtattcaagagagcaatacgcttccaggtttgtagcctaggagcaggctataccataaagtccaggtgtgtaggaggctacaccatctaggtttgtgtaagtacacgctatggtgttagtcaactaaagaaacaaatagtggtgagagaagagaaatcacctataggtgcacttctcagaacatactctggttttcagcaatgtatgactataaatcagcaaaaataaacggaggtgaaataatagttcctctaactgagtgatgtgattatgtaagaattttagttccttcctactatttttctattttcttccaacctttctgtgaagttactttcataatttaaaacttgtaatgttttattaaaaatagatatgtttgcggccgggtgcggtggctcacgcctgtaatcccagcactttgggaggccaaggcgggcggatcacaaggtcaggagttcaagaccagcctgacgaacatgatgaaaccccgtctctactaaaaaaaaaaatacaaaaattagccaggcatggtggtgcatgcctgaaatcccagctacttgggaggatgaggcaggagaatcatttgaacctgagaggtggaggttgcagtgagccgagatcgggcctctgcactccagcctgggtgacagagcaagactctgtctcaaaaaaagaagaaaaaaaaaagatatgtttacaaatatacagacattaataatggagtctgaggataagagccttcaaagcaaaggtgaaatgtcccaaaagacaagtcggtaagaaaacacaggccacgtcctaaaggcgttggagaactgggatgtgtgagagcaaagaaagggccttgaatgccatgtttaggggcagagattttcttctgtctgtagcacatattttgaattagaaagggctgttgttggagctgtctttctagagattccggagtcggcaaatggcatctaaaattaaatggattagaggtgagtggctattgtgatagtccaagtgtcaagcagtgtcagcctgactatgtggtctcagtgacaaaagagaggacatggtagatgtgagtgttgagtacaagactcagccaatggttgggtataaaccgcctgggagaagacaggactgaagaaggctttgaaggctagattctgggtgatgaatcagagatcaatattagtcacaaaagttggaggaagaatatgtgcagcttatttcgaacatgttgagcttaaagtgtccatggagtatcttgagaagattctgagaagttgcaacttaagagagaagcctgggctggtggtgtggatttgggaattatctgtatagacaggagaggtggtcagataataaaggaggagaccaggaaaggaagagcaggagagggaggaggaggaagaaggggaagaagggatgcacataagacagaaagagaagataggagaagataccagaggaccacactacagaaaagaagtagccgctgacacagccagaagcagcaaacagaaagaggagtgcatatttcaacactgcagagtaggaaacaaacaccaacaagagagtcacccttgatgtgaaatgttatgcaaagttcaaagaggctgcacactgacaagtcgctactggaaatagtgattaggcgctcaagtgacataaaaaaattttaagtaaaaaataagaaataaaatcaacatgtccaatgtcattgcaatagacactttcctgtgggaactaccattttaaaaacacatctggagtccaatatcctaagtgtcaagtcattcctcctttgtccacatggacggaagacgttcatctcttgagtgctaatggtttgaggccaccaccacagcaaccaacagagcaactgttgtactttaactctgcccagcactaactacattctagtctgtggcctgcatggaaatgaagttgttctttcagacactgctgtgtgggactcagtctggctgcaggtgcctgcaagcactgtctgatttgagatattttctataattactggaatgatgaaatctgtcatgcagtaaggtagcaggcaggagacacaaattcattcctagcttcctgaattaaaaataaatggttatcaagtccaattgaatttgttttaattagctgggttttttttttttaagtcacaattttcgcagctcctttatcaaactgactcttccttaatactaaagaggaaacttttcacacctaaaatattcctgtaaagacaaacttgctgggtcttgttcatgtccctgttggcccctaagtatattttacttatttgtctcatccattgcctcatgtctttccaatgtgaactccataaagaaagtgatttttgtgcatgtaatgaactgctgtatccccagaacttaaatcagggtctggcccatagaatgagctcaatggatgctggtggaatgaatttatggaagaatggatggaaagaaaacatacattataagaataaatcctcagaaggatagcagcaccattacagaatcaggtgaaggtgagtagactgaatatgaagaagatatgatgagtgtcccacctatgtggggagaagatgtgaattgctgtaatgagatataggaatataattaattggctttctttatatccagattggatgcagctttgattcttcagcattactgtaaggggatggggcggggaaaatccataataagctctgtgatcctacaaatttcatttcagaaagttagaaatttattaagcaaataagacaggccatgtcaccagcggatcggcatcaggcaaaaacccaacagtgtaattggccaatgctcggaagaatgacataacgaagcttggggttgccatgagatctacatgaaaacaatttctgtgctgaaccataggtagctcttgagtttataaaccctcaagtctcccattaatccagtcttcaataactggatgatttaagtagttacagtattttttaaaatcttaatcctgagagctaagtattcaatcgttttctaaagaaacgcagcaaagaaagtaaaatcaaacaacctgcctcaaaatggcagcatgtccacacactggcttcggtctgaaggcaccaaatgacctgggcatcctctagtatgttgcaaagtttaatcaccactagatcgaaactaaataccagaacacaggtgtgcatcattcaaattggcaaatcaatatattaatactttttttaaaagtcagtgagaaaaccaccaaaatcatttattaaagggaactcaagtggcacaggaagatcttcaagccaagtcccattcatttcccattaaatctgctacaagaaccttaaactgctcccctcaaagaaaaagttagttggacagtgaccagtgagatacaaaagaagaatcacaacgcccaactactaaaacccaggatggttttttaaaaaatgaatcccttgattgagggtcaccagagaagacagatattaactaatcacagaaagaattaattagaagctaggaggagaccagtattccaagccaaagtagtaatctgtgtgaagactttgctggaacttgtattatgtctgaaagattgaaataaagtgccttaatccaaactgggattttcctgactgacatctactagttcttcaggtccccagcctacacataaccacttcaggaagcccttctctactttatcttttcaactaaatcacgccttctgacactacattccctgacgacaccttctaccattgcttcattgaactaaaagaattatctgtaccctcgggtatgattatagagatgcttagtctaaatgcaaaccaagatacaactttagagaaaattctggagcctacagagtagaccagagaagcatctcacaatgaatcctccccaaataagtcttattctttctatatatgtcaagcattaagtaaacacttgagcagcacaagtcacaggcgatccatgctggccattaatcggcagtggcaatatcagtaaagtcaacgctcttccagcatctcctggactaagatcagtgtccagtgtttttattttatttttttccacagtattttgactatctcaagataagcttctagagaaaaaaaatacaaaaacaaatgtaacaaggtcaattgagctgcgcgtgctatgtctggaaacacatgtgccgtcacataatttagcacctaaagaacaagaggctgcaaaactgcatccccagggaagcccagagctggcaaagtaatctctgcagacatgaggaactctgctcacccactttaattttaacgctactatgtacaagcttaaatatagaatcaatcacaaagaaataatacatatttaagcagacacagggctaacgaatctgagccagtacaattctgaaaactttcaagtttccctttctcactctgacatttctaggcttgctaatagtcctcacaatgtccaggaagatccgtgtttccattattccctcctgttatcatacactgaccatatcttgtgtgcctcctagatgattcatacattttcttagctctaaaaatactacagttttagtgctagaataaatgtagagaacttagaagtaaaaaaatgttttgaaggtgagataggaaaaagccaactatcttgaacaattcaaaagactttcttagcaaatctcatttctgagagctttgtatagaaatttcatcatcagctttggctgctatggcaactagatatttcagaaatgatttgaaatgagtatcactacatatccagcatcttttgcaagaaacagaaaagactatgaaatctaatccactgtaaatttcaaaatatagtgttaattttcatttttgaaatctatttatgcttctatttgcaaatcaatagataacaacctggtacgattacatatgagcacgatggagaagtctttcattttagtccttaactgtcacattaaagcatcatttaggtactctcgtcccagttttattaggcctttaaaaaaaaaaaaaggctgggcacagttgctcatgtctgtaatcctttgggaggtcatggtgggaagactgcttgagtccaggagcctaggtaacacacagatacctcgtttctccaaaaaaaaaaaaaaaaaaaaaaagtaaaaattagccaggagtgatggtacacacttgtaataccagccactcgggaggctggggtgggaagatcgcctgaacccaggttttcaaagttgcagtgagccgtgatcacgccactgcactccaacctgggtgatagagcaagaccatgtctcaaaaaaaaaaagacaattttttgggcagttttaggttcacagcaaaattaagtggaaagtacagtttccatataatccttgtcccctccccaacctaccccactatcaacaccctgcatctaagtggtacatttattacaatcaacaaacctacatcgctacatcataatcacccgaagttcatagtttacgctagggttcactcttggtgttatatattctatgggtttggacaaatttataatgacatatatccaccattagggtatcaaatatcaaaaatcaaatcctgtgttccatctatttatccctcccactcttcttaagccttagcaaccactaatcttttcaccatctccatagttttgccttttccagaatgtcaaatagttggaatcacatagtatgtagacttttcagatagacttctttcacttagcatgcatttaaggttcttccacgtctttccatagcttgacagctcatttcattttagcattgaataatattccattgtctggaggtaccacagtttatctattcacccactaaaagacattttggttacttccaagttttagcaattatgaacaaagctgctataaacacttgtgcacaggtttttgtgtggacatgtttccagctcatgtgggttataccaaggattgtaatgtcttgactgtacagtaagagtatgtttacttttgtaagaaactgccaagttttcttccaaagtggctgtaccattttgcatttccaccaacaatgaatgagagttactgttactctacattcttgccaacattcagcgttgtcagtgttttggagtttggccattctaataggtgttaatggtatttcattgttagtttaatttgtaattccctagtgagatatatgtcaagcaccttttcatattcttatttgccaggcctttccttttagccatatctatgccaaagcccaagtcccactgaatcttgcacaacagaataaaaacaaggtcttcaatgatgagttagttgtgatttgatttaatcaatgaaccagccatggttttcacattctaccctgcagagctactattcctgggtcactgaaatagctcatagcaaatacatgctagagcaaagaaagctgtgtggaaatgtaaagtaatgcaatgactggataatttaatcagcatttacacccatgcaccttaactacatatatgtaaaagcatcaaacgagttctcaaattccctgcttaggtcatgacactgaggggttcaaatagaatcatcagtgtttgcttgaaagtccacaaagtaaggagatttattcttgattgaagttttcacagcatgttaccctgaatatttagggatgatggttaagggttatggaggtcaagatgaactggtagagagagcagcatgttaagttgtgtaagtgtttgctgaaggacaatggggaaatggagtgagagacattctgcaagtgtgccacaattcaaaagaaccagcatcctcattaaaaattgtgaatttattaaaataatggcaaagttattttggaagtaaactgatctaactataattctttttcctcttgaaacttatcaattttaagatacttacaatagtgtaatctcttaaaagttttctacctctgcacttaagtgtagaaacaagcttatgctgaccttttgaatagaatctaaagcaatgtgcattacctttatcaattctaaaaggcatttccaacagctcagtcttccaaaaatatactttaaatgtagtagttagtgcaaatgatatatcagaagtatcgagtaaagaagaaaaatactatgacattcatagatgtcaaatatgttagaaaatcatcagcactgtggatcaggagttctgggccagagctgtgggcagaatgggacattaaatggggcccttattaggaagttgacatctgagcaaagacttgaagaaagtgaggaagtaatattcatggtttatctgggggaaagtattctgagcagagacagcagccagcgtagaggccctgaggtgagagcaggcctagcacattgcaggaacagcaggagggtgagtggaacaaagtgaagggggaggatcagctgcaggcatcttaaaactttggcttcggccggccgggcgcggtggcttacgcctgtaatcccagcactttgggaggccgaggtgggtggatcatgaggtcaggagatcgagaccatcctgggtaacacagtgaaaccccgtttctactaaaaatacaaaaaattagccaggcatggttgcaggcgcctgtagtcccagctacttgggaggctgaggcaggagaatggcctgaacccgggaggcggagcttgcagtgagccaagatcacgccactgcactccagcctgggcaacagagcgagactctgtctcaaaacaaacaaacaaacaaacaaaaaactttggcttctactcagatagggagcaccttgggaattttcagtaaaacaaattactttgaaaaatttttcttatcatacaaaattttaaacatgagcaaagtagagaaaaatgatagtatactctagtgtacgtatgattcagtctcaaaattactgattcatggtcattactgtttcatttacactctctaccctaccctcaccccaaatcattttgaagaaatcttctgacgtcatgtcttttcaaccataagtatttcagtagggatctctaaaagacaggcattcttttctttctttctttctttcttttttaacaccactgtaatactattatcacgtccggtagcggttaaatcagctcatacctgctcagccaaagagaaactgtgtatgccactcttcccactcacggacccatgacttcatgaacgtggcttgaaattaaccatgaagggagtgtatacaccatgaaaatccacaaatactaacagcagggcttttatttctagtaataaaattgttaattctttactatctgatatggtttggatttgcgtccctgcccaaagttcatgtcaaattgtaatccccagtgttgtaaaaggagcctggtgggaggtgattggtccatgggggtggatttcccccttgctgttcttgtgataatgagtgagtccccatgaaatctggtagtttaaaaatgtgcagcacctcccactgctctctcttcctccttctccagccatgtaagatgtgcctgctcctccttccccttcggccatgattgtaagtttcctgaggcctccctagccatacttcctgtatagtctgcagaactgtgagtcaattaaacctctttttctaggtgaattacccagtctcaagtagttctttacagcactgcaagaatggactaatgcaccatcacacctctgactcacacgtagaagattaacaatgcttacttaataccattagatgtctactctacacaatggtcatatttctttggtaaacctttttttcagtttgtatgtctgaatagtgatcaaaataaaatctatactctgtgactgtttgatatcccttaaatctctttgaatccataggatccccaacatctctcttttttctggcatttgtttttattgttgttaagggaactgggttgtttgccctgtggagttcttcacagtctgcaattgctaattgtatgcctatggtttcatttaacatgttcctctgtttcctataaattggtcattagatttagtggcttgctaagatgcaggatttattttggggggcaagacttcttcataggtgcaggtggtgcacgtccatcagaaggaactgtcatgctggttgtgtttcatttttgtagtaataatagcctactgatgattctttcaaaatgataatattttgcattctatcacttattcttcatttactattttaaatacatctataagagaaatttatattaatcaatcatttggctaatttacactttattttattaattttttgagagatgagattttgctacgttgcccagcccgggctcaaacttctgagcttaagtcattctctattctccctggctcagactcccgagtaactaggactacaagcctgtgcctaatttatattttaacaggatcactctgattgctgtggtagaaaagactctagaggcaagttcgcaagtgtgaaaatagagaaataatctaggagggtgttatggctacctgggagagccatggtcacggctaaaaccagagtataactctggaagtagagagaagcaagtagggaagtccaaggactgagttgacgcacagccaacagcagttgtgagtgtactggagttatagatttttccacttgcaagtggctcagtaggttcctgatggttaataggttttatcatagctgagatgggaatttgggctctgggtgctacagctgggtataaaagcaaatcactcagcaggagggtgaggtaggggccgggagcgggtgttgtgaagagaactgatcatacaggtttcttgtcttaacaaagctctgagttatatacttaatgctaaataggcagttagtttaaaattccagttatgtacttttgaaagacagcagtggacattaatgatagttactgcgctggcttaaaaataaagaaaaagtaaagaagtctaagaaaaaatatatttgcacatatgtgatgtttgaggaagtcatgagattatcatgttaaagacctacttaacacattttcatcagcactctattattgcctatatttaggttgttcatgattaaatcacaattactaattgtagtaattataatctgttgtaaccctctcttgagctgtcaaaaaaagctgttgtattatttaacaacctaatttgacaagaaacttcagctactatattatttcaaggttttaaaattttcagaccatctgtttttaaatggtacatgcttcatttctttgaagacatctcatattttctcaggtagattcttttacgagtttttaactgctttcactggctaatttccgttcccaagtttttatgaaataatttacaaatgtattttcttttccagtgcttctaacgccactgattagttttctctaacttttgaatagaaaacaagtcgatggagaaacacattcagaaaaacacaaattctgaactccacatcatattgaatctccagtttctagatggagtttaatgtcgtcggtcacccatgccctcgtgggttcaggcatcagcgacgccactgttgctaataagcatgtcagcttcttagggaagggatgcagagaatcggaggacacgtttcccctgagacacttataaaaagaagagcataatcttacagctgggtgggccatgaaggttttccaacaaactactcttcccatcttttttttttttttttctgcaaaggttttcttatgcaagggggaaggggctcagtccctggcagctgctttcctcagggcggggccgggacattgcacaggctctctcactttctcttgggggggaagtgtgccccccacccttttcctgatgaacttgagggcctgtttgtcctgggagagcttgagcaactccacagcacaccgctctatgggacaaagccacacacctctcggggcatgtcttgcgcgattttggtgtttgctgaggcgcccgcttggctgtgccttggtttcctcacgttcttggtcaccttgtggcctttgttgaggcccacggccatggggtagtgcaggaccatggctgttgctctccgagggccgccgcagaggacccaccttctcttttgtagaaggaaaaaggtgtagaaaggggaagtgactttctctaaagtagagagtagccagtagacatgaatttggaaaggtttatgggggctgaagcatggaattcacatcagaataacgagaagagaggttaatggttaatatattttccaagaaaccatgagtagctatattctttctctcatctctttttcacacacacacacacacacactcacacacgtccacacacattcacacaccctcccatgcacaaatacacacacaggtccacacaacacaagcacacactactacacaccctcacacacataagcacacatgtccacacacatacacacacacccttacacacataccctcacatgtacatatatacccatgtccacacccttacacacatcctcacatgtacatatacacacatgtccacacacacgcacacacccttacacccttacacacaccctcacatgcacacacgtccatacaccctttacacacacccccacacaggcacatatgcacacgtccactcacacacacacgcacacattgttacacaaacaccctcacatggccatgtacacacgtccacacacatgcacacacccttacacacatacacatatgtccacacacgtacaaacccttacacacacaccttcacaggcatatatacgcacatgtccacacacatgcacgtaccctttcacacacaaatacatgtccacccaacacatgcacacactcttacacacacatacacccttatacacataccctcacacacttatgcacacgtccccacactcgcacacatacgcacacacctttacacacacatcctcacacatgaacacaccctcctgtgtgcacacacatacacacatctatccactcacatacacacaacaccctagatgcctagtttggaacagaagcggttaactggcaaaacatgttatgtgaatggcgtcccagtattttctttcaaatcacactaacaaccaggtaatgagatagtttgcaagggagaaagagtgtaaaaatgaaagaaaagtacttgcaggcaaatcagtatttgttcacctgttgaatgtgttttgtttgaatagatttttattgaaagattctattgtatttcccatggtttagatatttttccagcttttgtataaatatgaccatacaaaatgctcttgttcccgcccaatctctatttgcaatttactgaatgagtcatttacagagaggatcctgagaccatctaaaatactatgagtgggccctgaaaatgctctctttctactccctcctaatgaatttaagtgtttgaagaaaaacttactaaattcatgcgcctattaatagttccacaatgaagaagaatctaacaggagttcaatgtaaccactgtcatggcagagaaataacaaatgcatattatattttttaaaatcaggcttttttgagtgcatcaattatcctggtacttcccacttagtaaaagcagtgagtaggccctttaaatctatttattaattcactgagcgatctcaacaaactgttaaaaaagctttaggtattcattcaaaccaactaaaatacacaggtatcctttagaaaattaaaatctaggtaaagagaagataaaaagaggatactgattattgatcacccattctacgacgggccttttaataggccctatttataaatcaggtcaacacacgaacgtctccaccattaaatagaaatttgacaggagtaagagcattgtttctctgatgtatcgcccagcacctgcagtatctgacacacaacagatgctaagtcaatacttttgaatgaatgactgaatgaatgaatgaatgaatgagatgtcttcccagagaagtggttagtcccaagctccataacattgggtgggtgtcctcagccaaagtcacatcgcctcagggtacagaaatagaagacaataaggaaatgtgtttaatgaggatttcggtcatgtgttgatactcagctcttcacctcactccatcgactgacttcattcttatgattttatacttaaaatgtttgtgcatttggatgcaaacagccttaccaaggggaaattaggtataactctggagacaatgatctttattcttttttaagggcccgtttcaggcaatgatgccaggctttgctgttgctagggagatagagagaatgtggggggaatgagggggacattgagtgttttctttagcctgcaggccagggcacagtgaccagaatggagaaatagggccagcctgttctctcaatcaaatcccgtacagtccattgagaatagaagtagtcatgattacgttttggtatttagcctagaaccaccaaaaatatcagcctaaaacaattctattccaaatactgccatgttatttaagttgtcaattgttaggaagcatgggggcaattttgtgttttgacacggatatggattaagcacctgggagaagcatctgctctgcaaggtgacagcaacaagcctgacagagaaccagagcaaacagtcttttatcagctggtctattacctgagagacccagagaagactgtgcccagctgtgtgaatacttcagcaggcttgggctagacagctgctgagtgttcttcgcagtttctgtcatggcctggatacaagtgctcttaatctagtagattttaccatgagtctggctgctttttccagcacgctctccaggcctgttcattgattcatgctgcaagtacttacagtgagtctactgtgcggggggccctcttagcttaatatacacagaaaagacacttggttcagcaaagaaaagaaaggaggattcattaatagaaagccagctaatgcacagtttttccccccaaaatgtttgaattttttaaaaaattgcaggaactcacttcttagcacatcaggtctcccttgtctttttgccctctgtcatcttctctaaaccgaggacagcgatcagctacgtgagagtggtattcatgagtgaacacatggccaaaagaggaacacacaaactggtcatggtattttctttgcatctctcacaataacctctcctttaattttcaaggaatgcaagtcatctttagaaaatgacaagaataagtccaggcgcggtggctcacacctgtaatcccagcactttgggaggccgaggtgggtggatcacctgaggtcaggagttcgagaccaatctggtcaatgtggtgaaaccctgtctctactaaaaatacaaaattagccgggcgtggtggcaggcgcttgtaatcccagctacccgggaggctgaggcatgagaattgcttgaacccgggaggcagaggtagcagtgagcagagatcacaccattgcactccagcctgggcaacaagagcgaaactccaactcaaaaaaaaaaaaaaaaaaggaaaaagaaaaagaaaatgacaagaataaacaacataaggtgtctatgagaaacagaaatcacccaattgccctggccatattgtaggctgctgtaaagaaagttcactaccaaaagaaattcttcaagtgccgtggcatctggtgttaagattccaggcatctgacatttgccactcgacaggaaagatatagacaataaagtcatcctttaaggtgttactagaatgctctgtgtaaacttggtagaatgtaaaggtctgaggaacattgtgttataatgttatactttgcagtaccttttcctgtaaaggagtcctggtttactgaaaatttaggaaaggaatgcagattgtgacatttgcttctctggcataggaggcaaggcaaaatgcaaatgttagaattaatctcactttacagcattgcacttaacacacgcgttgaagtagcacagattcaagaatcaccatgattgccttcgttcaacagcttatgacacagtgcccagattccttttaatttcatgtaaaagaatcaatgtgtcaaactggcagagtatcctgaataaccctagtgagtggcattggaacactatggtcggtgctattcacaagacagcattccagagcaggataagaaatgtgtcagctcaaaaacgacattaatcctgtttcgtaagcaatattccattacaataaggtatactgcccaggaagacaacatgtttgctacttctagatgtctaaaaggtcattttctccagtcaaactttcattacaagaagacaataaaccaatatttgtggtcatctttctctttatgaaaaaaagtcaagaacttgagaaattgactgaagtagcaccctgtcttctaatgtagtcaagtctaccatgttctgttacgtacatttatctcaggaaacagtgtatatgaagacctagagacgaaggtgtgagagtgtgtgtgtgtgtatgagtgtgcgtgtgagtgtgtttgtgtgtctgtgtgtgtgagagtgtatgtgtgtctgtgtgtgtgagtgtgtgtgtgtgagagtgtgtgtgtctgtgtgtctgtgtgtgagtgagcgtgtgtggtgagacagaggaagaaaatatatgcaacacaagaagacaggactatgtctttttttttttttttaaacaatgtactgcccacgacagtcacggaagtgatgaaaatccagaacaatatgatgggtatcataaaattaccagggagtcaatgactgcccatgtaaaggagcttatagcagtgactgatgagtgaatcattctcagccttaaatgcttctcttacccaattcagaactgtcctacttcctgttaaatgtgttgttaaccagcaatttttaaattcttaatttaagatccttgccttgctttttaaaattcactattcaatcaaaggggttcacttggctatcaggaatatttttccccaaagaaggctacacaatgcacatttgcaagacagtggtcaaagaaattagccaggatcctttcatctcgatccctggagttggtggaatgcaatggaagacagaggactggatctgactatggttctgacacggactaatttttgaccaacaaggttttcatcttttgtcatcttttgattcctcgcttataaaatatcttcctcaaagcagttataaaaatttaaaatgagataaaactgaaactataggttgaaaagcataagacaattaaaagtattgctactgttagatattttgttagcaccttttgaaaacacaatttgtttttctataacaacttaggcattcctgaaaatcacacaccacagaaaattgagcaataaaaaccacagagcttaagagaaaagaaacagggtgcaacgctctaaaaattttatctgtgccacataaaaaacaaagataggaacctaataaaaacggcagcacagtgtttcactagttaattggctaagaaatacatacatactacaatagttttgtattttcaagacaatacattgtttctatcctgacaaagacctgaaagttggctcatggaagtgagcaccggaagagctaaagcttgtgagttattggaaagtggtagaaagaggattgtctgaagctggagagctgtcatgccagtaggaggtgttatgctcatatccaaggcctgaactgtgaggtagctggtagatgtttgagaaatgggcgttttatatatttctatagggctcaattcagctgggtgcagtttttttcattcactcacaaatgaaactatgcataaacaatcacgaaattcacattgcatgagaattgctccctaagatatcaattgtgttggaacaaatttgtgttttcaaatgagcattatagcagaactgactgtatcatgatatgtgtccccaaattggaaaacaaaaccccaaaataattacatgaaaatcaactggttctctttgttcctgctacttaaaaggagtatatacacggaagaaacacctcagcgcagctctgagcttctctccttttatcagcaaatagatgaacatttgatggtttgaaaaatcaatgacttcagacatgaatttcatcacacctctgtcttcctcagcatattatttgaacctcacaaaggacatttgattaggaaattaagatcaataaccagtagattaccaaatacagggagattttactttcattctccaatcattcatcagattttcatttccaatcttgattcactcagtaaatatttattgcacatttgtaatgtgtcaggccccattctaggcactggagatgcactggtgaacaaaacacaaaaaggtcactgtcttcacgcaacttacattctagtgagagaaacagactacaaacaatggcacattgatacatatacaggccttgtgcttgctttaatgcactttgtagatattgcattttttataaactgaaagtttgtgacaactccgcactgagcaaggccatcagtgccattttcccaacaacaggtgctcactctgtgtctctgtgtcaaattttggtaattcttcccacagtgtttcaaacttgtttgcattattatgatatctgtgatggtgatctgtgatcagtgatctttgatgttactattgtaattgttttagggtaccaaaacccacacccctttaaaatggtgaacttcatccatgaatgttgtatgtgttctgactgctccaccaaccagccgttgccctgtgtctctcccactcctcgggcccctctattccctgagacacaacaacattaaatttaggccaattaataatgctaccatggcctctaagtgttaagtaaaaggaagagtcacacatttctcacttggaatcaaaagccagaagcatgaagcttcatgagagaggcatgtagaaagctaagataagccaaacagtcagccaagttgcaaacgcaaaggaaaagttattgaagaaaattaaaagtgctactccagtgaacacacgaatgataagagagtgaaacggccttattgctgatatggagaaagtttttgtggtctggatagatgatcaaacccgccacaacattctcataagccaaaccctaatccagaacaaggccctaactctcttcaatcctatgaaggctgagaggtgaggaagtcacaggagaaaatttgatagctagcagaggttggttcatgaggtttaaggaaagaagccatctccgtaacataaaagtacaaagtgaagcagcaaatgctgatgaagaagctgcagtaagttttccaaaagatctagccaagagaattgatgaaggtagttacactaaataatagattttccttgtagatgaaacagccttctgttggaaaaagatgccatttaggactttcatagctagagaggagatgtcattgcctggcttcaaagcttcaaaggacaggctgactctcttggtagaggctaatgccgctggtgactttaagtttatgccaatgctcattgaccattccaaaaatcctaggactcttaagaattatgctaaatccactctgcctgtgctctatcaatggagcaacaaggcccaggcaatgctcacagtcacccaagagctctgatgaagatctatgaaaagattaacgttgttttcatgctaacacaacatctattctgcagcccatggatcgaggagtagtttctactttaagtcttacaagttaaaaacaaaatacattttgtaagtctatacctagacagatgtataataacatctatccatgtagatagtgatttctctgatggatctagcaaaaaaaattgaaaaccttctggaaaggattcaccattctagatgtcattaagaactttcataattcataggaagaggtcaaaataacaatattaacagaagtttgcatgaagttgattccaaccctcatgggtgacttaaaggagttcaagccttcagcggtggaagtcactgcagatgtggtagaaatagcaagagaacttggattttaagtggaggctgaagatgtgactaaattgttgtaatctcatgaaaaaacttgaacagatgaggacttgcttcttatgaatgtgcaaaaaaaagtggttttttgagatggaatctactcctagtgaagacgctatgaacatttttgaaatgacaagaaaggatttaaaatattacataagcatagttaataaagcgtagtagggcctgacagaattgacttcaatcttcgaagtccttctgtggataaaatgctctcaaacagcataacatgcaatggagaaatctttcgtgaaagaaagagtcaatcaatgcggctcacttcactgtcgtttatttgaagaaattgccacagccactccaaccttcagcaactaccaccctcatcagtcaacagccatcaacattgaggcaagatcctccccaaggaaaaagatttgctgaaggcacagacaattgtgaacaatttttagcaataaagaatttctaagttaaggtatgtaccttgtttttttagccataatgttctttgacacttattagactacagtgtggtataaacttaacttttatatgcactcagaaaccaaagaatttgtgtggctcgctttattgtcatattcatttatcaaggtgatctggaaccaaacctgcaatatatccaagctatgcctataatacataaattatatataatgttagaaagtaataaatgttatgaacaaaagtagagcgcagtgggaatcagaaatatataaattccctttcttgcaggggatttggtaaaagaagtagagctgtggtcgggcccagacaccatcggaatttgtaggccaaaggaaggggaattcactgataattttgtgtaggctgtagcatgagctaactcaaatgtttaaaagattattttcactgtactgtagggaatagatagaaggtaggaactatgagagccacttgggagccctttgcaatagtctgtgcaaaaactgatagtagtagcagtagaaatggtttaaagtgagtagagtcaagatatattttaaagttagagcccggggaacttattgatgttgaagacagagtaagaaaaaggatggcatcaagaatagcttcaaggtgttttattcaaacaatgaaacagtagaagctttttttttttcttcttcttctttttttttttttttttttttttttttgagatgcagaaaatggcaagaactgacttggggctgagggagagaggagtgccagaaatcaagacagtcttaataacagccaaagatcaacctaagaatgaaaagggaagcttcagcttgaattatttgaagttgaatagtggtcagtttttgttttttgtaattaaagtggacctcctacaccttgcatcttccccagccgtgctctcctgtcaacaactgtctgatatctgataatagctaatccctatagccttgcaatttcagaatagggggaaaatacatttaaaaaatttgatgattaaaaaaagatagtgataaccaagccactttcttgtggtactaaacatttgaatgtagtctctaatgttattactttttactaattttagctaaatacattccataaaaccaacaactcccacttactgattttcctgctccaagttctaacaatttttgtgaagtctctgggatcttctacatataaggtcatgtcatctgtgaaaagagagaattttactccttgttttctgatttggatgcatcgtatttccttttctagcctaactgccctggctaggacttctagtgctatgctgaatagaagtgtcaacagtaggcatcctcgtctttttttctgatcttagagaaaaagctttcagttttttaccattgagtgtgatgtcagctgtgcccttttcatatacagccttcattatgttgaagtaaattctttctacacatatattattaggcatttttatcaataaaggttgttacattttgtaaaatgctttctctgtatcttttgagatgactgtgtgatttttttccttcatttgttgatatactgaatcacattaattgatctgcacgtggtacagaagtagaaaaacaaacttagtttctcctactctactttcataacatgcttctgacactcattgcggggggttcttccccacacatcaagcaagcaatcaattcttgagcagacactagctgtcctccagtacagtcctgccactatctacctagagatagtgtttccatgccctctgcaggcatgccaccctccaggaacctccaagtgttcacctctctctgaacccaggttttgggggtttggggagagtgctgttacacagtcatgattgactaaatcaccggccactgaagaccagctcaacctttagcccttctcctctccctggaggtgggggagcaaggatggggctgaaagtccctaccttctaatcatgccttggtctttccagtgaccagtccccacatcctgaagctacatagggtagccagtaatcagtcaactcattagcataaagagatacttaatactttggagattcccggatttgaggagctgtattcaggagactgatggaagaccaaatgtaagtatttcacaataccaaacatgtggtgaggcattcttgcatcccaacgacaaatcccacttggtcctggtgtatgatccttttaatgacctggtgaagacggtttactagtattgttttgagaatttttgcatccatatttatcatagatattggcctgtagttttctttttttgttatatctttatctagtttttgtattgggttaatgctggcctcataaactgagtttagaagtgtccccttttcttcaatttttcagaagatgaatgtcaaaattccatttgtttatcaatgatgtgagccacttttttgttgctgaatcagatcatttaatagttttcagatacagaataatatatgtgtttactattatgtaaagtaatatgtaatagtgaaaggcattaatgcacttttaagtttatatttgcaatgttaacattttctccatcactttctgaagtcttgacagctaataaaataatcaatcaagcactgatttgtagtgtttgctgatttccctggggtaaatacaaacaaaagtatttgcacgtttggaagctgatttcaagcttccaatgtttgatatggagcccagagatgggaagaaatgagcagtttatttacaagatgtaaacaacctcaaaagcacagataattgtaaatggagtaaaaaactagaaagttacaagttttgagtattgcttccatttaatataatttaatgaactataagtttatataattgaatagttaatatatactgtttaacagccaacatgtgaattcctgagaatttagcaattggctcctgtgaaatactacaagccagctccagcacaccattgtagcttggtctccagaaaacaacttgttagaattatttggagccaaatatggggaaaggaccttacccttactttctgcattcctcttttcttacgtctccctatgtgcacaaaggaagctactgtcaactcttcagctgaatcaaaccccaaatcctgaggcaggcttctcaaggtctcactgagaacccatggcaatcaggactccactcccagccacccgggattccagtaatgaatttggggaggaaagatcatcagtggttatctgcacatcaaaagtatgcaccctttgaaaatatcatggaataaacatctctgttgctgacatcattagatgtatctttttggattatcaaggtttcagacttcagcttcttggccactcatcagttgctgctgttggatatatttttaggttctaaatatatcttacagggacaataatatcatcatctcctttgccaaagcagaagataacatttggcagtaaacactgaatcatacgccttcccagttcttccgagatttcctttcaaggccttggcttttccacataaacaatatcctgtcttgggttttccacaggaaaaccatctcctgccatcttggtgcccctcactcacttcaccttctcaactgagaggctgagcataatacttactccttgaataatacatttgtctacgtgttacagacatatcccctgtcactcaggaggtcctaaccagagagtaatcattctgatagaaatgggcaagtaaagacatatatagacaaaagattaaaattgtttggtcaatactggaatccagcaatcacacactaatggaagtatctcagtttttaagataatggtaaaattatagacatctataatatttcacattaaatataaaatgagacttggttggaatctatcacgtagatgacatcaaagagctctccactgtaaaaagtcatttcttatatttgacatcattttaaagtattctatgtgcatatatgcccttgccagcatctaaaaggcttctatcctgagaaatttctttcttttttctttttttttttcccagacagagtttcactcttgttgcccaggctggagtgcaatggtgcaatcttggctcaccacaacctctgcctcctgggttcaagcgattctcccgcctcagcctcccgagtagctgggattacaggcatgtgccaccatacctggctaatttcttatttttgttgttgttgttgtatttttagtagagacagggcttctccatgttggtcaggctggtctcgaactcccgacctcaggtgatccacctgcctcggcttcccaaagtactgggattacaggcataatccaccatgcccagactatcctgagaattttcaatgtagagctattgttttataagcaaaaatgatcaacatttatattttaatcattataaagcaatacatattcgatttgcttcatttacaaaaggcttcctggacttagccctttaaaaatgcacgacacttaatttttttttaacaaaaaagcagaaaaagatgatcaaacgaaggatactgatccatcaattactcctcaggaagacaggtggatcatgtgtgatttttcaaatgtttcaccagattgttaaaatgattaaatgaacaacctaagctcaacttgaaatccatacagatgtgatagcaccataaccatttcttaccctctggacactgtagtatggttgcctctggcatctttaacttggttggctgataatatttaatataaaaatcttcatggggtgtcaataaatgttagctttctactccctttctacaataaaagccattaaatcatgatttattacaaaaatgtgacttgactgattttcccatgttatacatccatgaaatgtaaacatgaaatgctaatataaaagaaaaatacaagaatatagattttactgttaatggtgcctattaaatgttggtataaaaataccctaagaaaatgcaacaaaatattaatggtggtagtgcctttaactggagggattaaaggtgatgtttccaagtttacataatgattgtgaaatactcctgggatagagaaataaaattttattaaaaatattattatgtttagagtcagggtcttactttgtcacccaggctggagttcagtggcaccatcatagttcaccgtaacgtcaaattcctggccttaagtgatcctcctgcctcagcgtcccaaaatgctgggattacaggcatgaaccaccatgcctgacccaaaagtttatttttaaaaacataaattttaaaaagataacataatcatatctcacttcactcattaaacatattctagaaaatgttttataatttaatttttgtttttaaaaagttcgaaggccgggcgcagtggctctcgcctgtaatcccagcactttgggaggctgaggcgggcagatcacgaggtcaggagttcgagaccagcctgaccaacatgatgaaaccccgtctctactaaaaatgcaaaaattagctgggcctggtggtgtgcgcctttaatcccagctactcaggaggctgaggcaggagaatcacttgaacccgggaggcggaggttgcagtgagctgagattgtgccactgcactccagcctgggcaacagagcgagactccacgtaaagaaaagaaaaaaagtttgaaaatgtcccaaagaagctaactactctccctgtgttttcccagccatgctgaattacttgtagttccctgaagcatcatgctaattccaactctgtgccctaataggtgctgttgctgatatattaggccccttgctctatgttcctcatgtaactatgagttttccttcaaaaccttccccaggaacactttctgagttctccactacaatataaatgctcatccttcggagagatccctcaatgaatttatcaacagtaagcactatcacactataataactgtggaaagtgatttaacaaagcacagtgccttctgaataaagaaatgaatgaatggataagcaactttgacactcccataacttaaacaaatggttgacctttttgttttctctcacttaagtgactggctgtttgactcgagtagtaaaaacaaactaggtgtcttgacaccctaaaaagggtgaatgttatctacataaattcaatctatacatttaattaaatagtatcattcaataagcattaactgatggcattgtaagtgccaggtttggtgttaggcactagaacatggaaaggaggaacagtgcttctttcctcaacaaactgagactaacaggaatagtcaggcaaatccacagttgcagtagtgttattaagtgcagtgttgaagcatgcactttctgtagcaggaacaaaaaggggtgctgtggggtgtggggacaagccttcttggttccaacactgtgttaaactaaaatgtagttgtatttacaatacaaagcttaataaaggctgcactggacaattgcctaatatcatcaatgtaaatacccaatgttatgtgattagaatgggcataaaaaataacaaaatctgctgttattaacaatgattcccactggaatattggaagacacactgactatcactcactacagaaagtatagaattggaaaagataattttatgaagatttataaacttttaaaactggtgtgaaagtattatttcccaaattcagtttgtagctggggtggggcgagtaggtagtataaatttcttcttaaattgtatcatgacagagaagtgttctttaggattccattgttgtggactaacaaagtcacttttagatatctcaaatttgaactttattgctcttcctatcttccaaagaaatgcactgaaaaataaaatggtctctctacagaagaaccaaaaagcacaagcagttttttttatcctcacagctttctgttttcaagcaatttggagtccccaggcggattcaaactcgatcccccttccacctcactcgggctctatgcactcccacagataacgagattgggtgagcacatcagattcactttccaaaggcacactgaaaaatcttcatgcagattaaaagatttttttaactatttcagcttccacatcttccaaacttctctttctcaaaccatagaacactatcatttgtgcagaacaacatgaagatgggaggttatggttccttcaattatgtctgagaattaagacatatgttatatatttactatgaaccttaaagaataaactgcacctagatctaataaccataattctaaataaccttctataatctattatatacatagtagccagatagacttctaaaaacatagctcaatcagcgctcaaaaatgtggcactgattgacagtgtataattctcactcattagttgtggaataaagtccaaaccgccgttctagaattcaagctcctcacaaactggctccaatctgccttcattgttgattaaccacatgtcccttgcaaaatctacgctccatccccaagagactctgtgttgttctctgagcattcagagaactcttccacctccatgtctgccctctcacggtttttcccacttgactaaccttcctcccatttcacctattcaaacctaactcatcagaagccctcctctctgaagcctgtctagattatcccacctgagagcaatgtctctgtcctctacgttctcactctgctggcatacatgtctcttgccacctctaccacatcttgctcacctttgtaagtaaacctcaccttgctcacctttataagtaactgttgttagcacatactaggtgtacaacaccacacctataagtgagtggctgaatctttttacaaaatgattcagaaggcatctcaggattatttcatttctccacataatcacacatatcgactaccattatttgatagattcagaggttgcaagatattggttgactatatattcactctttaactgatactaaaagttgttttagccagttaatctctaatagcagcttatctgccacttatttgattctcatataaagaaagagtattaaaaatctgatgtttgaatatcctacttacataaattcaagaaaagcaggggtttagcatatctgccaccctgaattcaattatctactgcatgtgttgtctctcatgtgtaacctgggccttgatgctaagccacccctcagagattctttaagttccaatgtcagaaaatttgagggtcctatggcatagaatgataagtaccaacatggttactactgaagatgttagtttggaaatacttttagatcatggagtgcttaagtgctatacagtcatatcaccaatagccttaccttttccacaagattttttttaacaaaatgtaaaatacaggtactgtaattcatgaattctcacataaaggacaaataaaaataggatcatgaatattgctcagactttgaatttttatactgtaatctaagaatactctgaaggacacaaatcaaattggtagggccaggaaataaaataatttctaaattctactaacagtaaaaaacacaaatataaatcttattaaggcagaaaataaaaaacaagagattttcaccatttagtttcatcgtttaaatatcatatttattatcatacactgcaaactccccaaactgctttgatattttcccttaaaaataagagagaaaacatgaaggcatctgattttgtgataatagaaaatttcttgataatatgtttttgtggctataagtgccaatgaatatatcaagttctaaataatatgcaatgttttaaataccaatgaatgttgtgacaatttttttcatttaaattgtgatgtatgtttgcaagatacagtctacttcctttaagctagagaggcgcctgtcagcgcctgtggaggcctaagaggaggaggcttacaactgcagtcttctccttcctccctgaccccgttgtaggaataagaagtaaatcttcagtcagaatcagcccatgcacacacaagccagtggcaaacctctgcccaagtattaaaggataaactgggcaatcagatttgaatctcaaaactctggactaggaaatcagaagaatgaactactgtaagtcaatgatatgaacgagtccaagagacaaagtagagggggaaagctaatcagtagaaaacaggcagatgaagatgcctggagagaagcagagctgccaacggagaacagacgcgagagctgtccgaggtcctgataccctgaggttctgattccagtcaacctgcagactcacatctatcctgaaatgcaacccaactccaattccacagagtcacaatgtacctaaattatttggacagacacagaagtcataataatataatttaacctactgataggccctgtgacaaaaaggcctaggcaaatggtaatttttaaaagcccagtctgcctgagactgaagcccagctctgtcatttattacctctgtggccctaagcaagttatttagtctctcttagtctccaatttatcatgtttaaaatggatataatagcaatgcctcaaagggttgttatgagaaatgcgtgagatgatgaatgtgtagtggttagcacagacggctccaatgttagacgatgatcaggagcatgatggtgacaacaatgatgataatttccttttccacacgggcatagtagctcaatagagaaataaattagctttaaatttaaactaactctatttacttattaccagcttgttcacttaagaaataggtagactattatagttaagattttaaaccttagatgttttgccttggagacagtttgggatgaaagaaaaatatataaaagcaaaaaaaacaaaaaaaaaagcaactttttacttaaaacctagattctttatttttcttcctaccaccacaattgattctaaatctcatgtataatccattttctctgcaaaaagtataactcatgcactcattcccttcatggagactttatgagggcctcatcattgaactttctgtcttctaatacgtgtaccctttttgcattgcatcagaagaaaaacttctaattcacagtcacctctaattaaatactcttctggaacacaccactgtctgctgaataaagaccagatttccttagaatgaccatggcaactttttacagtctgatctcagttcctcaattcatcccctactcatccctaccagcttttcatggtccttcctcatatctattcattttctctggcttttttccttgcccaggatctttttctgacttacaggtctggataaagacacaagtttttggcctaagtcttaaggttcagttcaaaagctctttcttaataaaatgcctcttatctttatactctgacctaatgattttcttttccttggtcatagagtattctgtatttctattaaaagacatcacattctactataaagctatggacacatctttccaaaaaagcagtagctatattttaaataaacagtgataaaaaataattgtgaagttcataaacaaggtaaccctgatatgggaaaattgttggtaaacacatttgaaactattccataggatgtattttaattcctccatgttcccatccacgacctgactctaaggagataaaatagaatcctgttgctacgggggaaacccaattatttaaacaacaaagattttctctagttcaaggtgaaaaactttcctaataagttggtgctcttgagcacaaaaagatgaaattagatataagggggaggcactgaaacccttttcaatgaattcttattgagcgatcacagtgatccaaactagcagaggatccttgtgcctattagttacacagaactcataggccaggtactattttgctattgaatctgcagtttggctctccacagttactcacgctaagctataaacataaaaatgaaaaatgaccataggacggtaaaaagggtactcatattgatgatatgagaggcatctttcatgtatgcctaacacactgccagtcacaggtgcacacacttaaacctgctttcaaataaatctctactgactttcactaggaaaggagaaacgtgtctgttggcaagaggttctcactccatttgggttattggcaacttttatacagagaccatttggcagactccatgacatcatgcagggattttagatctgatacttgttgtgcatgcatctctcatgttttaggacaacattctgatcacaaactattctcctttttttcagttatcatcaaatattgagacacatacagaggggaagggaggaggaagaggaggaggaaatagaataaaatatctgtaagtctcttacaggaaaatgtaatttttctcacttctccaggcaaacaggatgacttggaacaaccgttacattttttcttttttttcactatgctcctctgctctctactcaagaggctaccctgttaaataaactaaaatacagagtgatcggatctactgataaaacaaagtaagctctttgttgcttcacccagcaaaggtcactttcccagtggctttcagcttccccaggaaagtcataatactttccaaagcactcacattcccccgcctaggatgtgtactcaaacagaggtgtctctaggaacttcatctccggtttcactactaattggaaaatactgagggacagaagaaatccctcagcagtttcctcctgggaccctggttgcgtacgtacaccagctccttagtgagatgcaaaggatgaccactgttaacctggcttcctctcaagatcctccagaaagaattggataaaccataggctaccttcttgctctaaataacctcctcttcaattttcacatcagcttattaaaggtagagaatcctccagctataccacctgctttctttgtttctccgtgtatcagtaggcctgtctacaacagcattaccaaattgtgtgtctatttattgtctgtacttcaccttgttctttaaaaactgtgtttaatatttacctacattattatttgccctatgttttatcttttaaaaacatggaacaccaattagaaagacacattaaatgtcaacaattagtaaatttcagagaatcaaaaataacagtagaaaaagtaggattaagccaggtgtgatggatcacacctgtagtcctagcactttgggaggcaaaggtgggcaggtcgcttgagctctggagctcaaggccagcctgggcaacatgttgaaacccatctggcacacacctgtagtcccaactactcaggagcctgacgtgagaggatcacttgagcccaggaggttgaggctgcggtgagctgagatcatggaacagctccccagcctgggtgacagagtgagacactgtcaaaaaaagagaaaaaaaattaagaaagagagagagaaataagcaggaaggaaggaagagagagagagagagagaagaaaggcaggaagaaggaaggaaggaaggaaggaaggaaggaaggaaggaaggaagggagggaggggaaaggaaggaagaaggaaggaaggaaggaagagaaagaaagaaagaaagaaagaaagaaagaaagaaagaaagaaagaaagaaagaaagaaagaaaggaaagaaagaaagaaagaaacacacagactaagatcaagccataggtacaggtaggtaattagaaattagaatacctgccatgtaggcccttatactctgttagaggcaggccatagatatcaacttctgaacctcctggtgtttaaggacacatgcctataggaaatatagcacctgaaataaacttcataaaactgtttattatgaatgttttcatattgcaatgatgaaggcaatgaactaaatagcctaaagagtaaaaacatgttattatgggattccttattaaataatacataacaggcaagaagaaaagccaacagcataagttttcataattcaaccaagtatagggacatcagttgttacttgagctccatcatgtgtcattattataatgacagaagtagcagcatcaagaactagatccccacaatacatctgtctgagagcctgtatcattcattgccaaatgtgataagaatgtgaaagaatgctacactgataatagttttcatggtggaaagaaaagaaaagccattaatccagagcaaaagttagaaataatcaagaataaacgtatgtaggtatgttaaggttttatgactatacatttacagatgttttttaaactcttattattgaaattcctacaggaaaaatagctataattacagatctaaattatcctttttcccaatacaataattatgcttaaaactcaatttttgatagaaaaaggcttcttagagtacagctaccacattctagtacagactgtaaaataaagtaaccatattttcaaagcagaaataacatatggcttgaaaaataatatatgaatttggaagtttgtttttataaaagagtacaatttatgtacatattaaattacatttgattttagatttaatggctttttggaaaatttttatgaagtcaggattgttacaggaaaatttggaatgtagattttgctagaggtggatgctcttaaggactgtttaaaaaaaaggtctcacccaagtttttcataggaatctattcctgttcacatttttttgatatgtggtaagggattgtatttggagtcagggctttgccactggctagtaaccttgttccaatcatttagcttctagaaagttttatctccacatatgtaaaataaaggaagacctggtccactgcatgccttacacttttgtgatgctgtggacttttgagaagaacactgctcacttgtccactttcagccacagtacagctgcttagctacaagaaactacaggcccagctccactcctaacatgggattcatatctgtcctagtggactggaaatcaagtctttgtgccaatgcaaactcacataaccatactctgatggccagcactttgaccaggttaatttaacctgtctaaattttcaccttctgcctgctcactcctctaattttcaccttcccatgaccagctggtatcatggctgtctgttttggtgactgacagctagggactccagcatggttttttatctcctaggcatggctactatctgggatgcttgctctaataccttacactgtcttcttgtaacacagtttcttaaggcttgtgtctctatagaaacatgtcagaaaatgctatcttattatccctacccccaaataaatctacagtggggtcatttcatttatgaaaatactctggaaacaaagttgatgctcaggcaactggtctaccagggatagcatgattttttttttcttctctgcaatacctatgcacaaacttgtatctagaaatcaacaataaatgtgaaatggaagtcattaccactcaccgtcacaaataatgttttctttcattttccatatgggcaacataaaggagtgaaaataaccattgctgttatgcacttggtaggtttccatctaataaaaagcttcatatctgtaaaatgccaataacattcagtctatccttcctcatttccaacttcgagatctcatttatcccctactgttttcaggggttgactgaacttgtatccacaccaaaaccttccatgcccaagatactagtgagttacaaccaataagtattaagagaattacagaaattttgcatatttactttgacaggatacaaagatactatcattagaaaagtgagaaaagtctgtttgagtgggaagaaaagcattctgtcaataagatcagaacatgtacaatagtcagttggttgcttacggagtttaaaatttccaaatgctttagagcccagttatactgcctgggagtcttcagagatgggatacccatcactaatattaatattgatggtaataaaacctgtctccttccagcattaccctacacaaaagagttcttcttgtgataatgcaatgaagcgctaatcctctacaaagggctcggtgatatcagaataccatacgttccctttaatgttattccataatgaccataaagtgcctaattgtcaataaccacttaagaaacaggttctcttgggtccttaagtgctggataatgtggtgctgtcctcagtaccaggtaaaaggaagattttttttagctctaggaacttaggtgaaatcctggaaacatttgacaatgtttcttgtgtgctgctggtggatggatcatagatataaaacatacatgatggtttataactaggctttcccattgtatagcagcaagtgctaatcaataagtcaataaaaacttgatggcaatttttctttgttttttttttgtttgtttgttttttgttttttgtttttgagatggagtctcgctctatcgcccaggctggagtgggtggcgcaatcttggctcactgcaagctctgcctcctaggttcaagccattctcctgcctcagcctctcgagtagctgggactacaggtgcccggcaccacactcggataattttttgtatttttagcagagacggggtttcactgtgttagccaggatggtctcgatctcctgacctcgtgatccacccgcctcagcctcccaaagtgctgggattacaggcgtgagccaccccgcccggcccttgatggcaattgctaactcaagtgagggcccataactctctcatctgatatgacctgctattagtggtagatgtcacacatctgagggtgaaagggaatataccacatgatctatcagattcaaaaaacaacatgatgaaaagccaaattgaatttaataacatgtaattaagtagatttatgtataaagccagtgtgtgggtttaaataacccatcacttgaagacataccagttatacagaagcttatctgaaacaaacctgaagtctccctttgactgcaagctcagtgtgacctgaaagtgtaacggggacaataaaacaatgaagctcttgaaaacactcatgcattaacagaattagagtatccagaaagtgggttgtaaaagttccactgtacactctattagtcaagctacccctatagctatatttgtttatggaaactctcttccaccctagaatctaaaggcatatattcttccacaccacacagcaaaataaaacgctgtttctcaacagactctggggactccaacagcagggagggaggtgtcaggggcaagggttgaaaaactacctattgggtactatgttcactatttgagtgatgctttcaataaaagtccaaaccacagcattatgcaatatactcatgtaacaaacctgcacacataccccctaaatctatttttaaaaaccctgtttgtatttacatgtaacattgattttcattggtccattagtacatctctatttagcttgacttttccatgattcctatattaaatgtgttcttcagtagaattttccttctatttatttaaactctttgttccagcaaatgtcaaaagccaactaaagaggcactttaaagatgctgccaacttcagatcctctctatcaaaaatggaagaaagtctaatttaagaaagagggtatttccactcacccattgtgctgctgattattgaactggaagtaaccacaaggtctgcaaaacctctgaacttcattttgaggaagaagaaatgctagtcaaaatttacttagaatctattaaatttaaagtattataatataatgattgaaagaatggacttaaaaaaaatctaggtttgaatcctggctctgctacatgcaacttagctttggcatgttccttaacttctccaaatctgtgagtagtttaaggattaagttattaatatatagtatatgtaaagtgcttagcatagtgactcacatatgataaaggtacaatatagtttcactattatgttgctgccattgatattatattattattattacttattcacttgcatactgtgagacaaagtttagacttgagatttagcaattgtgtttgttactctagttctgtatttacttactagttacacctaatgcagtatttctaacaggaggaatgtaaataagccactcttcaggggtagagctcttgacaattttactgtcagctggaaatttgaccaggaatgtttcagagagaagcaaaatgagcaatacagcttctattcagatatccagagttagggaggcgtaaggtgattattcattcattcacagcagaaagatgtatggtaatgcagagacgaaaaatatcagtgtcactagagaagcatcaataacatgctgagggatttcagcagatacaggaggaaacctgctggcctgggaatgtttaatttgtaatggactaagagaacaatcgagtttccaaaattgtactttggctacttccattgctgaatttcctttccagccactgccccctcgacctctgttacagtctttacatttttatgaggttgactttcaaacatttattccaaagagcaccgtgtagtttttaaaagtaatcatgcaaggaacagtaatggaaatcgtaagcacaggactggagttaagtgaagcatcagccagttaggggctgtctagaggaggcccacaggaaggataatggatctgcaaaccacatcatgtgacatatgattaaatgaaacagaaacattaatcctggaaaagagaaggcttagggaggccatgattgatgttttggtgtaggtgacgtgatcttgtgtgaaaggagattagatatcctatgtaaatccagaaatgtacattagaaccatgggaaagaatgccagaaaaatagattttatattaatgtaaggaactaatttataatcgtttgaggtgtccaaccaagacttcctcctgaagatgtggactccttcccactaaaagaagtcatagagagggagaaaattctggcatgcgggagagggaggactgaatgagacaacttccgcggccccttcaccatctaagagtccatgaagtatctaacacaacgaaacatttcctttttagagaaaacctaattaattgtggaaagctgttaggaaaacttgattgtgttttatatctcccatctgcatatctgtaagcaaaccaaaagcagaaacttactggcagcttcaccttctttggcgagtttagtattgtcaatacagtaaagcctctcaattctgcatgcaatttgacatgaacagaaggaagaaaaaaaattagaattccaccttcagaaccacctaggagggtgtctgacattgaacaggtaatgaacaatgaacaggaccatttccccagcagcctttgttttccctgccacctgcaagggatggacagttttatttcacaatgatgaacagtgatgtcgggctgagccctccactctgtctcaattcactccccacctggagggaaagggataacaaatacaaggtcttattttgtttttgaagggtctttcagggacaggaaaagcagctgttgtagtttagaacagacttcaaaagcagatcaatagagagccagacccaggtgctccttaaaggcatcgactgctacaatattgtcatttgcctcccttagctttctctaccactttcctctcaagccctgctagactactggttttgatagagtaacactctgttgtgagatgggattgtttaaatgagagaaagttcacatgtggaaatctgccatggggaatctagcagtaactagatatgtcccatttgggtcattccaatttttatttcaagtctgttagaacagatgtattcaaaatgacatctagataaggccaggcggataagaagagacttcagctgggacaagaactactttgtgagttagaaaattgggttcatgtttccatgtttataatcttggctaagtctgtaactgatattcctcatctaccatatacaatgaggactgctgtgaggactaaaaggaaataatatctctggaaacactatgtaaaatccaaaacactgtgtaagtcttagatacggcactcttttactacacataatggtcatggtttgactgaaatctcaacaattttacagcgaattaagggaattcactgtattttcttattttcattaaggatattaaaactatttatatagataatatactctattagcaagattattaaaaagcaatttttagctttagatatcttctccagtacaaagcttttctctttatttttgcatcttagttgtctcttcttaacagaaaaatgatcctttgtatttccgtatgttaataagtttctgtgaaagttagatgacttccttacaaatagtaattaatattattgtaatagcaattataatattatagttttataaacattggtgctgtgatgtcaaaccagattaatatattgatctgtatatacatatatatagtatatacatacatatatgtatatgtatatgtatatatgtatactcttgaaagtattttagtactccgtcgcttccccaaaaaggtaaactagatattaaaactctacctaggataaacagataatggacaagaagagtaaaagctttttcacaattcttagcttctgcactgaagttatgaagatcgtggttaactaaaaagttaaaaatctttttcccataaagagtaatcaagatttccactaatcacaaggccggtggttgaaatagcaagattcatcctcaggcttgcactttcttgttgctggagagcaatggggatggggaaactctcggtaccacggtcctgggattggctgggtcataaagatcattccacaacatgggattctttgatcatctcagtgatactccccccagcctcaaatgctcagggcctctgagccagtccacctctcagaagaggaaacctaatatcccgcaggggcccattccacagtgaaaggctgttagttggaaagttctttttaccttgcagggcaatacagtgggaagggactatccagtaaaactcctccaaaacagtagtaaccactcaattcatgaagttctctttctatactgcagttttctaaagtaacataaaaatatccatggatttttcactttcctttgaatgcggtgaccattccttacctttaccaaagaaattgcaagaaaaaaaatagaaaaaaaagagcatctcttggcaaaaggtcccatcagtaattctagttatagaatcccttcaagaatcattaattgtgttacactacagaataaaccaaatatttatttctgcaagcatcattaaattatgacatattagaagtcattaacaatcagcaggcaagggcactgggttctgccagtttaatgttctgaacaatcaaaaataatatccatggggcaattaatttcctgcacattgattattccaatctccacactaataagtggggctaaaccaagtaaaatcaaaacagcacagcaaaaaactgcagactgatcccacttgtaaaggggagtctgtaaccttgacagatgaattgtatttcctaagttatagggggagaggaggaagttattccagcaccctaaatggtatcttgaggagctagcatgatccttacatccactatacccctttcacacacagagatacatgcacatttcacaaatgtaagaattaagattcaacagattgtccaaatcaagcccctagtaataatgtcgggaccaggatctttggattagttctatgtactttccactctgtgggcaattcaatggatgtttaatgattctggaattggagaaaaaacaatttctattaattcaacaagttccacagcaaactgcaaaactgccacttttctctgggtttgaggaactacttattcataaaatattagtcaaccaatgtatcaaatctgttgttaaaatgttatccagaattctaaccctttcttccttcatacattctttaatctgtcaggcatttaataaatatccactaaatttatcaagtgatgtgttaggtcctattggaacacacaaaaatcacaaaaagatcctgttcttaaagagctcaaaagattttaaaacacacacacacacacacacgcagagtgatgtgctggtagatgctcttcatcaaccagttttccaggggctgcaggagaagccttgatttacagcatttgccacttcccatgatacaaatactccaaccatggctaatttcaatttttcaacatcaatatggggttgtggattcagggagatattaaaaactgtctaaactggctctagtgcaccactactgatacactgctgatatgagtgtgtgtttcactatataaaagaactaatcaaatattttagagttgttatgttagagtagtgtgattatgattgcttcttcttcttctttttccttttttttatagcatccaacattttttatgaagaagactttttttaaagataagtactagtagcaagattcttatcccagaccactttttctacatagccttggtataaccaaaattatctgaggagtagagaggctaaaatattttgatggcacatcagattcgctttagagccacatgtcccagtagaactaagaaaggaaatgctgcagagagtgtccaacttctaagaggcatcatcagacttcatttagcactaagtcttcctgagccccacctatgtgaccatatgaccacctagatcttacaaaatatatttgcagagcatgccacctccacacattcttaagattttgaaatattcaatcataggatgtatgtgaaagaaggggaggaagtagaaactaagagaaggataatccctaaaacataggaatccagacagaaatattattgcttctgcagaaaccctaggacaggattgaatgactcaccacctgtttggttttatggttacatttcaacagtgtctgcagctgtaactcatgcttcctccttcggctttcttaacacacagatgcactctgttttggaaccaaacatctttgtcccattccagaaactcttttctttcttaggactatatgaatgattaaccctgtaatcttcaaggttatttattatcatttttaatgtgaagaagtggaagttttgtggagggaaaataaaacgccttattgcttgcataacattttaacatttatgaaacaattgcatgtaacttatcacagttatcacaataatcctctggaataggatattcctggcaccttcatatgtgaagataaagaggctcagagagtttaaaagactcactcaagttcacaaagccacagagtggtctctcactgccttaaacacatgggcttcagaatccatattccaacccagtagggaagtagcttggtatagtttagagaaaaacaagatgtggagttaggcaggctagatttcaaatcttgacaccaccattttccatctgtgtgatcttgggtaaaatccttacactttctaggcctcattttcctcatttgtagcatggagagatgacactcaccttactggactgttaggaaaatcaaacaaaataaaatttggcataagatgggttctcaaaacatttcttttctcttttccaccattctgtactccattgttcatgcctcttgtccttgtatcatccttagttcaaacatactcattttgtttcttgccctgactcaaacggcctctccagttgaacaaccagaagttgaacaatcatttaatggacagtgtgttctaccagagtatattgctgtagcaagaattagaccccacacaattgggaaatcagggaatcactgcagtctaacatggaagccccactggttcctgcacaatttttcttagcatactgtatgttgtgccaccaagacacagcagctcaacacaaagtacacacagctaggaggatggacaagtcatgcagagatacagtactgaatgtgcggcccattataccacgctcttcctcttggctccatctcactaaatgcacggtttccaaagtatttattgcacacttcaatgcacaaaacacacaagcaaacactcaagaaggagccagaaccgttttatactaagcctgtcactgctcctccacctgcaaattctggtgccaatgctcctctgacttcattttcataactcaggcaactcagtacttccgtacatactcttccaccaacctaccttccccttcaatttgaaaggtaaactcttttatttactggattatttatttgcagggacattaacatgttcttataattgtgctagtattttccataagctcactattgttttggttagtgtttaattataacattaaatgttttgagtgtttaaaatgttttgagtaatctgttccaattctattttcctcaaaacgtcagttatttttagtgagtgatttttcagaatgtgagatttttaaaaggaatacatgcattatgtgatggcaagaatgctcatattttgctttgttgtgtagctattttttatatattgaggtgccacaaattgatgtgcttatttgactctgttaaaatccaactcaggaggaactcatctccatggttaagaatgtacaatttccaccaaagatagtaccgaggggggaaattcatactacttttcataaatatgctaaaccaaatgattctaaacataaaatagtgtatccaatatagcattgaaataaatctatccagtactggcctatctctacaactttaagcagcttttgctttattatgtaaaagcattccatttttaaatcagctaaacttccaagcaagcaaagacattacaagaaaagattcttcagctacagaacctgtcacatgaggaaccaatttccagggtaagaaaataagctcaaatattttaaaaaaatgtttcttcttacccctagcatactgagctggcagtataatgaatcagaacattttcatttgcatttattctttgacatgggcaaatgacaacctttccaggctttcactgtaggaaaatggcaattttaaaaacttgaataactatcctattaattttatgaagttgttataagagataatatatagtatattatatacaaatatatgtttatatcttatatattaaatatatatatgtatactggaaattacttgtaaatctgtttacccttcaatcttgagactgtacagtactctgataaagaacatattatcatcatcactgattccttatccccagccacttttagcaaattgccttgcacatattaattttttttaagttctgtgatacacatgcaggatgtgcagatttgttacataggtgaacgtgtgtcatggtggtttgccgcacctatcaactcatcacctaggtattaagcccaacatgcattagctatttatcctgatgctctctgccccccaaccccaacaggccccagtgcgtgtcgttcccctccctgtgtccatctgttctcattgttcagtcccacttataagtgagaacatgcagtgtttagttttctgttcctatgttagtctgctgagattgatggcttccagctctatccatgcccctgcaaacgacatgatctctttcctttttaaggctgcgtagtattccatggtgtatacacaccacactttctttatccagtctatcactgatgggcatttgggttgattccatgtctttgctactgtgaataggccttgcatataataattattcaataaatgtttgctacattaaattgaaccatatgcataatcaaagtcagagtctcgctgttaagttgtttaaaggactagatttattcctagagagcaaatagattgttcttaaaaggcactggctatggctgttgaattggttaaaattcagtttggatgcaagtgacagaaaacacagattgtaatatcttaaagaaagtataagctaatttttctgtagcaaagaagtttatgtaggcaggtcaggtatggtgaccctgtaatcatcagggaccattgttgttctaccgtcataaactctcagcttgtatctcctggccaagatgattgcattctggcctgcaagaaaaacaaaagaaaaacaagaaaggtgcatgccctttttttaagagcgctttctgaatattacatcccagctgtttgcatcccattggctggaatatattatcttgccatgcctagcagtgtaggagcctgggagctataatctttattctgatggccatgttcctagataaatggttagtgccattactacagaaaaagagggaaaaaataccaaggacagaaaggtttatcacagtttcataaattgacagtgagctttgagtcaaatcaatacagagcaagtaaattaatttgtttctgataaactttcagggcaagaccatcacatgtgttttaaggatgtagataattctagttaatgaggagagttagaacctatttccaacagataaacttcttttgttggaatccattcaaattcccatccctaatgatctatactaaaacttaatactaagccacaccacatcgattaaaagaaatattatgaaaagaatgcataattgcctgagactaagatatcaggtgaaaggagagagctggttgtaataatcttttcacacaaaaccaagtgaatggtaacttttttggttataatcaaatacatctctcttcttaccctcagaatagagggaatgctgtatagtcactaatgctgtccaaacttaagtgcattgggaataaaaggatggggagactaaacaaagccaaagaaataaaataataataataaaataattctgagagcatctgggatattccttaaagaatttataagattcttcaggagatatgggtagcttgccccatccgaaaactccaaaaacagttatttcataggtctaaaacaactaaaactgaatttattttcactgtactattatcttagtatttttcttaattacgcttcatcactatcatcacccaaaagggtcaattattgaggtttcattcaaactaaaaccctgaaaactaaggatggaaagataagaataagcaaaagataagagaaacattcaaatggaaagaagataaaagaaaaataaattagaagaaaaagaaaatactagatagtgactcagagaagtagaggctgaatttggaggaaaataggagaagtaagaaagtaaaggagagagagatgaaggcaagagcaaaaacactagtgacagaaggagttacacacaaagaaaacaaaaggcaaagaggatattttagcagggagatagaaatcctcttacaggatgggactgccagggaaatctctgaaacgggaggcaccatctaggcagcattattcagtaggagaaactgttcaaatttaaccatcgtttggaggacatcaagccctatttttgtgtgatcctgattttccacattaaaacacagaagctcatggagatattccaccccatttacacaatcacgaaatcgtagaaatggtttggtttcttctgtcattgaatttgatccttacaacaccatcgtgaagcagaaattattatccctacttcccatggaggctcagagagagaaactgacttgtccaagattatcttgaacaatgtgagtcccaggtctgcaacttactcggtgtgttgtggaaaagtcacttagcctccataaaaatcatctgtaaagtgaaaataattaataacaagtccacaggttttcacatataaatgggaatatatatacgtacatgtaaaaatacttggtaaaatgaaaaacataatttgtcatatttactaaaactaaaatgttcagtgtaaaaggctacagggagttacatgctgctagtcctttaaactattaggattgaaaatgatggaaaaggagaaggagaagaaggaaaaggaaggaagaaaggaagtaaaaaggaaggaaggagagagggaaagagagaaagagaggaagacaaggaaacagaccaacccagtaacaacggctaacactgtgcattattgtgtgccaggccctgtactaagtctttgctcatttaatcaccatagcaactctaagacgcaggtactattattaccccagtttgcagacagggaacgtgagccttgaagaggtttagtaacttgaccaatttatacagctggttagcgagagagcctggattcaaatccacacaggtacaagtagacactcttcaactcttttttttttttttttttttttttgagacagggtctcactgtcacccaggctggagtgcagtggtgcaatctcagctcactgcaacctctgccaccctggttcaagcagttcttctgcttcaccctccggagtggctgaaattacaggcccgtaccaccacacctgtctaattttgtatttttagtaaagatggggtttcaccatgttggccaggctggtctcaaactcctgacctcaagaaatctgtccacctcagccttccaaagtgctgggattacaggcatgaaccaccacacctggtctctggtactcttcaagtcttatactgcctggatattagtcagctagaaataacagtcctatgagaaagagcgaatatcataaaaatctcactataaaggcaggaataggaaaatattaggcccatcagcacaccagcagctaaaaatattacccccaggcagagatttagcacgtgctattttaacgtccagtggaatgaaggagatctcagtaaatgaaagtaacatcagtcactctaataaggtcaaatggtgctacaagaagagaaaaaacctccatgagattatttcaattgctaatgaaattacaaattagcctttggagctcagttcatctttcctcagcggatagtgagctaataagtaaatgtaaaaagcaattacaaaatttacacagactttaaaaacctccccatgatcaaaaagctagctcagaagtttcaacaaaaacaacagagttttggttagacagaaatcttagtggttgtatagtccataggccaaagcccttcctaaagtgcggacaatccgacctgccttttaaagctgatagattgtccgaagaatatatataaatgccagtgagcacttgaaaagatgctccatcattagggaaatgtgaatcaaaatcacaatgagataccacttcacacccattaggatgactattaccaaagaaatggaaaataacaagtgttggtgagcatgtggagaaattggaacctctgtgtcctgctggtggagatgtcaaatggtgcagccactagagaacacggtatggcagttcctcaaaaaattaaaagtataggccaggtgcggtggctcacacctggaatctcagcactttcggaggcagaggcaggaggatgacgaggtcaggagatcgagaccatcctggctaacacggtgaaaccccgtctctactaaaaatacaaaaaattagtcaggcatggtggtgcgcacctgtagccccagctactcgggaggctgaggcaggagaatggcgtgaacccgggaggtggagcttgcagtgagctgagattgcaccactgcactccagcctgggcgacagagcgagactgtgtctcaaaaaaaaaaaaaaaattaaaagtacaattaccaggtgatccagcaatcccacttttgggtgtataccaaaagaactgacagcagagactccacacagatatttgtatatccatgttcactgcactattatatacaatagtcaaaggtagcagtaacccaactgcccattgttaaatgaatgaataaacaaaatgcagtaaatacattcaaaggaatattattcagcctttaaaaaggagaaaattctggcacatgttacaacatggatgaaccttgaggacgttatgctatggaaataagccagtcacatataatacaagtgaaataagccagtcaaaaaagaataaatactacatgtttctgcttatatgaggtacctagagcagtttatttcatagggacagaaagtcaaatggtgattgcaatgggactggtaggggaatgggaaattattgtccaacaggtgcggagtttcagattgggaagattaagttctagagatggatggtgataatggtcgcacaacaatgtgaagtgtacttactgtcattaaactgtgcacttaaatatagctaaaatggtacattttatgatatatatttttaccacaatagaaaaacaaaaaaaagaaaaagtaaagaagacttctttgtgtaaatatgaaaagaaattaaagcacgttgagtaagaggtgtcccttacctaaggatccaagacaaataacagagtaattttatttacctttttatatacctttatcttctttaaaagtgccttatgtacaaactaaaaaaatttatatcctaaatgatatacgggatttgcttcaaaataatcaactggggcatagaggaagtggggaagtagaaatgaaacaagatttacctgtggtgaatcattgttgacactatgtgatgtgtgcatgaaggttctttatattatttcctccactcttgtattcgtttgaactatgccacaatgaaaaattgtaaatgttgctttatatttaccatatacaacagttttaaacaaaatatcaagccactgaagagcagtgaattctaaaataaggtaaagaaaatttttaaaagaaaatattccttagatgtcatcacttccattggtaggaaaatccatgtcccttttctggacaattacaatgaacagttcacatacactgaagaactgttatttatacaagctttacatgcactgttcacataatactaacaatataccactttacagatgtggaaattcagactcacagaggtaaagtaactggattcacgttaagtgcattttaacccagacagtctggctacaagcccttcagcttaacaagtacatttcttgaattacgagggtatttttttcttctttcctgctagccaatttagacagcctcaacaatcctgagttgccagaattagaaaagcctgattgagaacctatgaaaagaggtattttgttttttaagggatatgatcaatacctttgcctcatctgtcacagtaaatccctgaggagtttcaacattagcttaggtcaatttagttcatttactgagcacctactaagtgtcagaggctgttaaaccttgggcactgtgctaggcactcagattcgcagaggaatataaattattcgattatgaagacagatgcatgcgaatgctcattgcagcactgttcacaataacaaagacatggaattaacataaatgcccattaataacagactggataaagaaaaatgtggtacatacacatcatggaatgctatgcagccacaacaaagaacaagatcatgtcttttgtgggaacatggaagtagctggaggccatgatcctcagcacactaatgcagcaacagaaaaccaaacactgcatgttcttacttataagtaggagctaaatgatgagaacacatggacacatagaagggaacaacacacattgaggcctatcggagggtggaggatgggagagaggagaggatcaggaaaaataactattgggttataactatgcttaatacccgagtgaagaaataatctgtacaacaaacccccatgatatgggtttacctatatatcaaacctgcacatgtaccccagaacctaaaataaaagtttaaaaaggtagtcagtgaactacgacatgatactgtattgaaaactaaaatgtaatcatgaaggtggaatactagaattccctgagaagagtttttataaaggtaaaaaccaacatattaacatgattgtatatttatctggaaataactacatttctcaacgcctatttttctattataaaagtgagtaaaatgaatattgctcctacttaaaagatacattgaattagagactattgcaatataaactgcaaggcctggtatggcatcttggagaagaaaaaatcacaaattccaatttccaaatcaaagaagcaacaaatcacaataaaaaatttaatacttaaggccaggcgcacctgtaatcccagcactttgggaggccgaggtgggtggatcacaaggccaggagattgagaccatcctggccaacacggtgaaaccccacctctactaaaatacaaaaaataagccaggcatggtggtgcgcgcctgtaaccccagctactcgggaggctgaggcaggagaatcacttgacccaggaggcagagattgcagtgagccgagatcacgccactgcactccagtctggtgatggagcgagagtccgtctcaaaaataaaataaaataaatacttaaatgtttctatttttcaacttgcagagtttcaatacaaatgtaaaacatacttaaaataggtgtttctattacattatttgctatcagagagcaataaaaataaaatttgataaaaaaaactgtcaacagaaaatagaggttaacatagtatttattttagaaaccagaaaaccaaaaataaataatttatatcagtcagttcttcctctttcatggtattaatcatcctatgatgaggtgcttggcatctgtgtttgccatggtaaataagctccgcgatggttcagacctatctgcactgtccaaaactctatcttcagcacttaccatacacatagctgccccatacacagccaaggccaatgcatatgtaatgaatggacttgaattcgaatgtcctgtccattcactcatttatctagagagcaacacagtaaagaggcaagagtagggactttggaccaggcattcattcactattttattcattcattcatgcatctatgcaaccaatattcgaggacacctattttgtgccattgttctaggtcctgagacactgcagtgaaaaacaggtgtttccagcctcacagagctcgacagttctgccactagtcttgggaggtcactcagtctgcgtaagttgcctttcagctttttatttttagaaaaatagaatactaataaccaatatggaagattattttaaagaaaacaagtcatatacataatggacctggcacacagtaagtaaacactcaataattaacaatcaaccaaaagcctaaaaacaaaataccaaatataaaatttagaaccagtgacaaatgacattgatttccagagcgaatgcacctagaaaagttcaaagagaaaaaacattgtaataatattaattatgtgttaatagccatattagtatgaatctattctctctacatggtaccaaattttcttcaaaatcccttggcatacaccatcttaagcattaacaatgaaaaaatgtccacagatttctgtactagaggaaaaaatttctatgaaaccagtttggctgacatggagagctttgtgtggacaatgaaggtcatgtagatttgtattgttcttgacatcttctaccaatgagtaaatggaggaaatcatgtcaactgggcttctaaatgatctacagccttggggacacacagcaagcagaggaagacttggtcaggaagtgttttgcaaagatggcttttgcaaggacactaagggaagttgagacacttgcccaagcttgcatagctactcaggggtggggtgagaattcacatccagctcttctgactcgcggtcctttgacccttcatgactactactctgcatgggctatcaccctcctttaaaagttcagagacttagacaagagaagagagattataaaaaatagattccttttataccttttatacctcaatttaaaattctcagaaagggttctaaacactttaaatcccttttacccagaagcttctggtttttgctcagtcttgttaggaattggagtggctgtgatacatctctgagatgctatgaaatagagatgaattgaaatactttcaacatcagcaaatcatctgaggccccataaacaccctgcacagtacattcatggtacatgcaggcctttgtcttactgaaagacaacctatgtcatctgatgttaggagagtcactcacttcagaccactgaaagtttcaaaaaaagagaaaaaaagtcataaaccaagtaaataatcagtgtcatttaccattatatctaccattcccttacgaggccatggtctatggtcttcctttaaaagttctgttgtattctcttgaaaaaaaaataatttgttgaactctactttgttttaagcactgtatgcaactgtttaagtatagcatattgttttatctcttgtcttggacttgatgctatttgttcaaagtcctttacttcctgccactgtgctgtccaatccaatggacactagccaccaagaccatttaaagttaaatttgaattaattaaaattaattacaatttaaaatccaggtcctcaataacactcaccacatttcaggtgttcagttacctcacgtggctagtggctactatatcaggcagtgagcatatagaacatttcggtcatgatagaaagttctattggacagcatcgccatagagcatcaaatccaggacttccagctaagatcagatatgaacagaacgaccaccagaataggtcagactaagttcccaatcttatcgttcctggggttccaagagctaaactacaggtcagagaaaaaaaagcatctaatctatttagaggggttgactagatatcctggtataatccacgatgcccatgaagcaaccaggatgctgattattcactgacactaaattacaaacacaaagtcttagtggatttattgacagagaaagaaagagaggccatagaaagacaaataaataaagacctgaattcaagctgcgtgacttcaggcaaattgtgttacttctctgatcctaaatttcataatctgcaaaatgaaaaagtagattaactctgagtttcctttcacctctgaaattcctggattctaaggctttatatagtttgcataatacccaaggaactgtgcagactgccaagatatataagacaagatgccaaagactttcccattaatgagtagaggaagctgtctagatagggctaaacaatgtaagacgggacattttaagtatcataaaaatggtattaccaatgcatcctacagaagcctcctctttatcttaccagaaaaatatgactggaggtagtggaaacattcacttttctttcattatcaaaaaatatggtaacatagggtaccccacctggcatatatcgggtgtttaataatttttgttgaagaatagtaataagataaaatgataataatattaattatactagcaggcatgtattggaaacctaatatatactaggttctatgcaagacattttccccaggctatcccattctagcatcaaacagctctatgaagaaaacattaaaacattttttatttttttatcactttatagattaaaaaactgcagtgaaagaagttaggtcaccaaaccacagccacacaactaaacagtggcagagctgagatttaaaaccaagacttcccaattctagtgcacatgcttcctccatttccacccattgtctccttaagaaaacttttacttgtcaatcaccagaaaggaccaaagaagactctcaaactttttaggaacccagctaatttcacaaaactgccatttcctatatatttttccagacgacaaaacaacaatgtatctttccagataggccactcagccaaaatattttctagtctagaccaggtggcaatttcagtggagctggaattgagttcatgattgcctgttagtgttccaatgtcctgagacttttgttaattagacacaagacaaagggcattaaaaagaagccaagttaaatttgcatggctgtgggcaaatggcagaaagaagtgggcctttgtttcctacggaactgggcacccactctatcatctacaattattttataattgggttgatattttgtaggatagaagcctgagtaaccctgacatccatatgcctccttatcactgtcatgaagtggaaagcaagggccaattatttgtgttgctcgttttccacaatcttgttttcaaagagacttaacattaaagtcactaaactgtccaaattcaaagtatttccacattctctgcagtgatcacattctgtcacccacacttcctaaaaataccctgctttccatcactcactagaaccacagaggctattagaaggtaataaaatccctcgagggcttctcttttgcacatttgcactttcctctgatcaattagattcagggagattggaagtgggaaataaaagaaataaaattcaggccacaaatccttctcataatcccacaagtagcactgacaaacaacaactggcaaggaaagagctcaaccctggaagactctcctgctctaaactcaattattatccaaaattcatcattaaatgattactcataaaatccttctatctacttctcatcaagaaatatcatcatggaaatatcaatgatggtcctatcttatctcagggtacatgtcagtattagtatcactgagataaaaacagatctgaatatgtttagggtagacaacatcctttggtccagaaagtttctttcaaataatctgatttacaaaagacactccatttaaaaatttttcagaaatggcaagatccttctctcagtgcctgcctcccatctgagcccttaatttagaaatctgagggcttaaaaggaccatgcctttcataatgatcttttacaaacattccttccttttctagtgcgtctttgtcttgttgtcccttgtatatattcctcactctgctaacatgtagtaaacccagacggattaagaaaactaaggttcaaaaatgttaaagatcaactgggcacggtggtgcatacctatactcccagctactcagaaggctaaagcaggaggttcacttgagcccaagagttcaagaccagtctggccaatacaatgagaccccatctcaaaaaaaaaaaaaaaaaaaaaaaaaagccaaagattatttttcacgacggggatttcggcgagaaacatcgacaccctcagcgttgaccagatgggcagtcctgcactgacaaacccactgagttaatgtagaatatgtcagctagctcaatgctaagagaccagtaatatctgtggcccagtctcttccagagaagaaatcaagccactcctctctctggcaagtatgtctcctctcataaaacaggctgacttcagaagtagctttcaaagacaatgcttagatcaagccaatcagcgtaagtactcttcctggttgggtgatagctctcactgtgacttcatataagaaaagccagtggtcttgtcttgctcttcaagaatggagcagtcacggctgggcactgtggctcacccctgtaatctcagcagtatgggaggctgaggcggaaggatggcttgagcctaggaattcaagaccaccctgggcaacatagtgagaccccatctctagaaaaaacaaaaaaattatacaggcatcatggcacccacctgtagtcccagctacttgggaggctgaggtgggaggatagcttgagcctaggagttcaaggttaaagtgagctatgattgcaccactgcactccagcctggtcaacagagcaataccctgactttatttaaaaaaaaaaaaaatagaatggagcaatcttaaccctaaaataacaaccttttgccagtaccaccatatgataccatatgtgaaagatttattcaggtacctgagcttcacaagtaacaaggctggcatctattctcttctccaaaaggcattgtttcctcctttacaactaaataaacagtgcaaattatgtcctcaactttaagtcaggtttgaaaagaaaaaataaaaacaaacgaatgcaaagcaagagactatataaggatgaagggacagcacaggagaatggaggagagaatgggcataggagaaaggtgaggggaagggggagaggggtgaggaacagtgaacttggtaagtctgctatttccaaaaccatgtttactgcagtaagataatgaatgaggaaaacattttcattttcttttctgacagcttgagcataaatgatagctgcaataatatcagaaattattgggcattttgaggagtcttgctagtgagaagccagcattccagccaatttgaagctctggccccaaggtgacctagaaattttgtttttcaaatgcaggaatgtcagctgctggactgaaagtgatgtatactgtctagtggacagcatgctggccagacaccaaatttggagtgtctctccctgtactcagttgttctttacggccagtgctgcccccacaaaggagagttttgtctaaagccgaccaaaaacgggggtagtgtttaagatccatcaacaccaaataacactgagttttgacttgtcacctctacagattcttcaagaagctgatctgaatccaacacctcttggagttagttgggtctcttcttcctaaggcagttgattactactagttctaatctagttaggggcctgactgaaggaggcctaaaaagtgccaggaataaaagcagtcaagcctcataattttatgtgtttttaaacaagacaccctcaagtacataaaacaccacagccattgtaatttaatcatctgcttatgaaaaagacagcactctaaacagaagaactgataaggcaaataatttgcctataaggatttttaaaatgtgtctctgacatcaaatgaactctactgagattccctgtattatgccaaaaacctactggccaacatccaagactgacttgcaagtaccaaccctaatccggatcatgaagcaacattaccatcacctgtacccttcaatagggtgatatccactctaccttaacaatcagagttttatccgctgtacattttttccataagattcctatggacttctccatggaaaacagatccctggaatctttctgtgatttggaggaactcctgtaatttgtatgaggatagtgataacgagagaaacatcaaacacacacaagaaatttacacatcccagcttttctgtgtattccactttggaaaccaatagcctatgaagataaaatggaaacagcacatacatatcttgagtgtgtgtaaatcatcagagtcatatgcaataagtaaacaggaggtgtcatgaggagggaaaacaccacgaatattcccagttcagaacacactttcaagaacgatgcttcaatagtgaagtagaaggggaaatgggcatgagtcaatagaacagcaatttctctatcctttctctccactgttactaagcaatgtcctattggaactgaactttttttctaagtcttcgattgacttcctaattaataagcattgtaatctagtgtttattcctttatgaaggcagagcagttgaaatatcctaacacacatattcaaccaacacccctctccaattattgtgttgttcttcacattgaaatttggcctctactgagaagatattgaatggaaagcccatataagatagaaaaaatagaagcataatggacacacgaaatatgtgatgtcacgatctatgtctacacacagataaagaccatttgacctgataactagcaaatgataagcaaggacgctgtgtctctttatacattatctgatattatttatatattgttatttctatcacaaagaaaaacaaaaaacatatgctcagagaatacaagaatagacagacaatccataggtaagcattaagagtaaaatgtactgaaaggagttactttttccaataatgccttatcaagaaaatctttctttgacaagtaagttatatgtggtcactaataataagcaaaaagctaataaaagaagggaaaaatgagtagcacaagcagttcccagcttaatcaacaaaataatcatgctttaaaaaatgaggtagtacattctcttcctgaaatcattacagtctgttaacttaaaagtaaaattaatggcgattcgatgctatacaacactgtgtagagtaaacccaaaattaccaatatgaggctcaggtacactaaacagtcaaataactatttctgaaagccctgtcttcttattttttctttttttgttctcataataactgactgaatgacacacactagttgctgcatatttagtttatttctaatgaagataactattaggtgtccaatctactcagtccttaatcttttaaagggaaacagagagggaatacaattgtttagcctaacggaaatagcttactactataattttccaaccaaaagtctaactcttcacattgtatacacccataagatagaattcaaaattctcacagcttgcatattacaatactcagagtcttaccaaacacaaaatattatgacttatttgaaaccaccgaactccccccaaaatatttcttctcaaaaccaactctaaatagaatagacaggtatccagttatttcaattaacttaaaaatacaatactaataatttaaactcaagtagattattttcctgatttatgcagttggaatgctttaagactaacatagaaagctaagttctgatttatctttcccatcatactgttttatctcagacacatataaatgcattcataggtacacagtatagtactgttcgcccaggctagagaataaaacagctagcattgtaccaggacgcctgtgcatctttccattaaagccatagcaatattccctcaaacacatattcatcactaccttttaatgattctgggctacacggatgaaaagttttgatttagtgcaggttaaagtagcacatagtctttcatctttattcataatcagctctgatccccttgctgaaaaagaaagaaatgcaaacatcttgaactcttcaatgggcttttctctaattaaagcctttaacaattttggggtgtttcaaagcatgacttcctttttaccattgttagtgttaactaaagaaatattgcccaataagcactccagataatatactcaaaaaatcatctataaaatgcaataaaaatgattggggcagaagaacactgcatccttaattttagtaagattgttgatgataaccagagtgaagctgcctaagcaatcactcaaaagcacatgtaatagttaaacgcatctttattatggttgctcagtgtctaaaagtttgttgccagtagcattgctattaaatgtataaggctgtcaaatctatttgtggccaaaaaaaagcaactctgcaagataaatattatttaatgatttaataggcatacggcactagaatataaatacccataaataccccaagtcataaaagtaacagaaagtaaaaaataatttaggctaagacaaaaaaagactagaattgtttagtcaagaacgaaattagtaaaccacatacatttacacagacacagtctctcttgccacaaaattgcaaagtggtctacttttatttctaaaatgtgatatgcttatatcattattataacctaaatgtttaaagggggtataagaaaaagcttctaaaattattacggatgctactaaatcatgtgtataacaaccaaaatatctggaatgcccaaacgtgctgtcattgctcaggacagaataatctattcaaaaccagcagggaacacgtgaggaggcctcatttacttcagtgtgtttccccacatatgcatcatttgagaatgtcagatcactttcacgtatatagtacataatcactgatgatctgggaaatccacaaggccacaaagttgatacatactctgatctagagggggaaaaaaatcgagaaagccggaagtttcccgttttccaagaaactgaagacattcttacctttctgtacaccagcatgttgggtgattcatcggccaccccgttgctggtctgcccataattattcccctgggccatgtcacccaaaacttggtccactctcaagatacaagaattatcagtgtgccctgcaaagggtcagagagacttcagtgagatcccagtgggactcccctgattcatcatcatcattcacagcacccaccccacatggcgcgttcttacaaactggggctggctggagaaagtgacacaggacatggattttttaaaaagtgagttgacacctacaataacctcaaggaattgtaagaaattacaatcttccaggtagaaatagccatttggttattgttttagctgacttcattttctggatactcattttgagaagtgtttgatgctcaccctaaaaactcgtgggtagcattttcctagtacagagttctcttctctcccaatacttgcatctgaacttggtgatgttttccccaaagggtggaaaggcaacacctgggggatgcggtgggggagtggggggcgggttagcacactttctcctaggtatctgtctagtgtccccacctgcagcccatcagagaggcccattcccggtgtcattctccagcgcacgggcttcctctctattcccccgggtctcccacacagagccggagtatatgcttcgcctactttcacctgcctgcgctgccagccaccggctgctctcctttctccccacttcgcttcggaagtccggaggtaatcctgcctaatttttgcaagaagacaccagaatatgtcccggcaacaagaactagtgggaggtcaagccttcaggccattttacccgggtcaccgtgggtaaaagcctaactgcagaagcctccagagcaaccagccaaagaggagaaaacaggcaagcccctgctccccttgctcgctctcacggcagcagcaaatggcaggcgagcctgtgccccgcgccgcggcggccgccggagccgggcagcagtttcagcaccgtggaccgcggggtgcgcgcggcgcccgtagcccagccccggcgcggggctcccgggggcggccgccctgcgcccgcggacgctcccgctgcgcagagcgagggctgggtgcgggccgggggccgggagggctctgggtggcgctgcctcctccccgcccgccttccctatttacctcctccgccaaggtcacggccccgcggcgtctcccctcccgggcgggctgggtgcaggcggtgtcagctggcggcaagcggagcagcgaggcagggtagcttcatcacactcgcggcggatgcggattccgcgccgccccggctctagctgctcaggcgaccgccaccctcgcctcgccgccgcccgtgcacaggcggctccggcagccgccactcgcgcccgctcccctgggccgcctcgctggctctctccctcctccgcttcttctcccggggact

SEQ ID NO: 826 - DNA, 76 bp, Homo sapiens
catggatttgattgaatgattctcccatttccacatggagagtggagcccagagaattgtttaatcatgtatccat

SEQ ID NO: 827 - DNA, 102652 bp, Homo sapiens
gtttggaaaaatgactcagtaagttcagcgcgcccgctccggccggccctgcgcctcccgccgcgcccgggatgtattcgtccccgctctgcctcacccaggtacggtcctcgcccggccccccgccggcgcccccgcgccccccgcatcccagccccggagttttgaagcaggaggaggcgggacgaaaaaggcgcgcgtccctcccgccatccctgcccgggatgccccccgcgccgagggctggggtccggtggggggatgggtcaggctggggtaccccccccacacccttacctaccgcggaccccctacgcgggactcccgcccagcacccccaaccccgactctcgggacctctcccggatgtggggcttggtctgcagatttgcgtcccccccccacacaccgacgcactccgcacccccgccccgacactcggaaaggtcggggtgggggctggcccccctccagcaagggctctgcgggaagccccccgcctgcctctgagaggaatctagggggtcgtgattggaccctgggtctccccagctggagagaaagggacctctcatgtgttttccccgtgtccccccaccaaggttgtgcgggccgccctggccctcggtcgcctttccctcgttattggcccacgtgtgcatggagggggagggggcaggagaagttggaggcccaggagggggaagggtgctccggcggcccggctgggtcccccctcctttgcaagccccccagcaccgtcccggtattttcgctgcatcgattctggattctggattctggattctggagccgccgccgggaggagcgggaggcccggcgctccgggtctggcccgggcactgcggcgctgcggacgccctcgccagcccggcacctgccccgtcccctccccctccccctccccctcccgtagcctctcacccctggccgcactcccagactgccccggggccgagccttgtgcaatggccgagggggtgtgtggggagggggcggctccccccggggactccttccagcccaggctcccggggaccccgaggtctgcaagttccgttttctagaccgctgctttcctccttacgcagtgtgtctttaggctggagaggttctggcctcagtttcccctgaagtgaggtgcggctaaggccggttctggagaggggacagtatggcgggcaaactgtaaagtcccggcacgtggggggtgcgattccagcgagggccaggcccgtcttaagaagcactgtgtggggagtatatgagtccccggcttccgctccagggcatggtgcagtgagggaccccccacgccaggcatgctccttggtagggtctttctcaccggccccctgcagccgacagggaatgtgggagctggtgctgagggggtctgaggtctgtcctacctgtgatcccctgagtgaccttgggtaagtccctgtcccagcctcagtttccctttctgagcagctttggggggggggttcccgaagaaggcatctctttgaagttctccaagaacaactagggttcgagtgggcacgctgtgtgacctcgggcagcctttgaagtctctgggcttgtggggtgactgaggtgtccccgctctgtcctcaccagctggaaggagccatttgggagggctgagcggaggggaggctgttccaggctggggaggttggaaggctgcctgtgcaccctggaattcccccatcagggctggttgggagacatcctggttgctggggtgggttgggggttagtaagaaccccagtccaggctttgcctcagagaattgctaactcggcctcagtttctccaggaacagggcaaggaccagccaggagggctgtctgtggaaaccaaaaaacggagaggctaaaaactaaaaactatccaggggtgctgcgtgcaagagacagagatgagaagacagagacaggcagagagacagaggcagagagctcccaggccagagtggggacagcgagtcccaagtgcagggggctccctcctcccctgcgattctcctctctgccccgccctccaccccagccctgtagtggagctggggaccccctttccagtttgtcttcagcctgaatgtaatccccactgttcccccaaggcccagcctggtctggggtagccagtggggtgggctgggggactcagaaggaccctgagtgccccatgcaggagcctcccacccaagtcctggctgcctgactcagtttcccgaatcacgtcccctccgtttctctcatcttggtctctttttgtctgtctttctctctttctctctgtcttgctctgactctgtgtgtgtgtgtgtgtgtgtgtgtgtgtgtgtgtctgtttctccctgtctctccatctctgtctctccccgcctctgtttcactcccagtcactgttggtctctttgtgtctctctttctcatcctctgtctctctgatgtctcagtctctcccactgtctctgtctcttcatgtctatctcaccatccctttctcctctttgtctctgcatgtctctttgatgtgtctctgtctctctgtctctccctccctttgccttctttgtgtgtctgtccgatgtgtctctgtctgtttctctgtctctgtctctctgcccccttcctctctgtctctgtttctctccaatatgtctgtctgtctcttcatctctgtctcaccttccctttctcctctgtctctgcgtgtctccccttgccccctctctccctgtctctctctatctctgcatgtgtctccttactcctctctctctgtctctctctgtctctgggcctccctctcccccttttcccagctaattttacaacctgagcccaaccgaaaatagctcccttttagctgatccgacccggatccttctcgggagccgaggctggcggggggtggggggcatctcggtgccagcccgctctgtgccacccgggcccggcccgccgagtggggagtgggtgctggcggccctggggcattctgggagccccgggccgggctcagcggtgactcaagcgctttttcacttttactcttaagaggaactgtgtggagcccatggctcccataaatcctgccggcgggaaggccggcctccccgcgcctgctctgggcctccctccctgcctccctcccgctggcgccaccgccacgttagttattccgggtttggggccaagtccctcttggccgcagcgtggcggattccccgagccacctccatcccgccaccgggtccctgtctcattcgttcgttgtttccttcattcgttcgtcccatgccctctcggagcacaatgtgctttgctgccatttctccagcagggtaaccgaggctgggagaggctgtcctcccaccccagacccccgacctttgttggattttctagatcttccttaagcatctcctgggccctggggataggtgggggtgggggaggcagcagggcccaggcccagtgtaggttcttagagggagcttggggggtgcctaccaggagcagggggcctgcagcccctcagtgccgggagaggggctaagagtcagagagggccagggcctgcccgaggtggcacagtggggctggcagagctggggttcaggccattttccatctggcggcttgggcaggtgggcgctctctccccgtgtgccccccacccggggcctggtggcctctgattcactctctacaaggctccaccactctcccgctgtatctccctctgggtctctctgtgcatctctctctgtttctccccctcccctctctgcggcggaggtgcctctgcgcgccagggccaagcgccctgtaaatcaccaaagctgggattctggcagagtcagcgttctcctctctctctctctctctctctgtctccctccctttctccccccatctcgctctctcctcctctctccctctctccttctctgtctccctttccgtctttccctcttcctttctctctctctccccgtctcccttctctccctctctccttctctcttctctctctctttctccctccctacctccctctctgttcctcttctttctctctgtctgtctctttctttctccctcccttcctctctctctgttcctcctcttctttctctctctctgtctctctgagctggcctccctccctgtctcacaccaaatggatgggaaatgctgcctgggcctcctgccccggacacggcccgccccccactctcctgcctgtgtccacgccgacctcacctgggtgcccatctgccctgagcacacagcgtgcgggcacccaagtcctgaccagttcacatccatgagcacacgctgggcgcacacgcgtgcacactccctgacacccatacggacgaggacacagctctgcctgcctcggatctgccttgatgggggtcaccaacacacagacctagagtgcccctcacatctgcctgaaaatcttgctcaggaggtgccaaacccaatatagtacctggtatagagaaggtgccaaataactgctatagagtggtgccaaataagtgttgctgtgcttgtgattgttgctaaactaattctcctctttcctgactctggtgggtgacctgcccccacccccggaccgtttcttgccctgaaatgaagtcagcagaaacccccacttcctcagggctgctgcagattcagggaggcagcacaatttttttttttttttttttttgaggtagagtctcgctctgtcgcccaggctggagtgcagcggtgcgatcttggctcactgcagcctccggggaggcaggacatttctgaggtccacagtgcagggcttggtactcagtaggtgcccaataaatacctgttgcacgaatgaatgaatgaatgaatgaatgaatgaatgtttttggttgagaggcgggactttggtcttcccgagcctccatttctccgccaacataaaataaaaaacataatggcactttcctcagagacatcgatgtaccttagtccgacacctggtatacagtaggtgccaaataagtgctgctgtgcttatggttgttgctaaactagtaattgcattgaacaccccagaggcattttccagtttccctcccttccctctgtgtgtatttgcgcagcgtaagcccagctttgggctgggtgacaaggacagtggtgacctggaaaggcccaggctcagacccctctctactgtggcatttctgttagtttttcttttctttcttttttctttctctctccttccttccttccttccttccttccttccttccttccttccttccttccttccttccctccctccctccctccttccttctttccttctctttctctctctctccctctctctccctctctctctctctctctctctctctctctctctctctctctctcggagtcttgcactgtcgcccaggctggagtgcagtggcgtgatctcagctcactgcaacctccgcctcctgggttcacgcgattctcctacctcagcctcccaagtagctggaattacaggcacgtgccaccacgcctggctaacttttgtatttttagtagagacggggtttcaccatgttggccaggctggtctcaaactcctgacctcaggtgatccacctgcctcggcctcccaaagtgctgggattacaggcatgagccaccgtgcccggcctctgttagtcttttctccctgcccagccctgtccagggtctccctgagtttgaccagccctgtgtgggtaccagccttccttacacatgggggtgcatggataaggggggtcccagaggcagaagatgggagcattgcttcagtggtctggatgctggagatgctaacagatcaaagctgtgcccttgtgggaccgacagtctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcccgagactgtttgctcaaggggcccaggagtggggtgggggggtgccaggaggcccagggaccagtcccagctcagttcctccctgactgtgtgactttggtggaagatttcatgcctcagtctcctcctcgaggtagtgggtgcaatgatagtccccactttcatagtagactttttttttttttgaaacagagtctcgctctgtcgcccagactagagtgcagtagcacaatctgggctcactgcaacctccgcctcccgggttcaagcgattttcccgcctcagcttcccaagtagatgggattgcaggtgtgtgtcaccgcacctggctaattttggtgtttttagtagagatggggtttcaccatgttggccaggctggtcttgaactcctgacctcaggtgatccgcccgcctcggcctcccaaagtgctgggattacaggtgtgagccaccgcgcccggcccctatttcgtagtagacgtgatagctcagcaaacgctcagcctgtaagaggcacagcctcgctccctgcctctctcctccacctcctggcccctctggctcagccctcattgtcctcccagaacatcaaggcacagagggaagtaggggacccagggttcattttgctgactcactgccttggcagagagtttgaaccctgtggactcagtttacccaaattcctcactgtggcccacaaggccctgcccagcctgtccttgtcccctcctcaaccctcccctcctctctctttcccccttgctcattctgctccagccacatgggcctcctcgctgttcctctaacacgccaggtgcggtcctgccccagggcctttgcatgacccatttctccatcagaaagctcctggcctggagtgccatctctcaagactttgttcaggtgtctcctcctgcaagagaccttcctggaccccccccccaagctaaaaaacaccccccaccccagagattctctggtccctcaaactcttaaatttcttcagagcactttgcccaacttgacgttttattacatattttgctgattttaaccatccgtccctgccccagatctggatccaggtgagggccgagcccaggtccctgccaagtcctcggcaccctacctgggaccggcatgcagcaggcactcactaaatgtttgctgagcaacagaatgaatcttccctctctgggagccgttcacatgtccacaggctgtgattttctgagccaggggaaggagcggcccaaggttagagcctgacgctggtgccggatgggcctggggttgtccgtgggaccatggacaagtcatccgacccggagaagaaggcattagaactaaggctttgaaggatgcgtaggaatttgggataagtgctaagtaggtaatgagctagattctcatgaaggattgttgagtcacttttacctggaaacttttggtttggaaattggagtttcttgtcctggtttgctggcctggactttcagggtgggaggagcacagggaggtgagtgagggcatcacccagtgcatggcgtggtcgttcagcaaggtcttgggtccagatgtctctcccagctgctgctgctctctttggccaggaagtcccagtgggctaagctggggtttccaggaaagacctagccttgttccccttctccccatcaccttgcaaggaacaaggtcaccaggcaagctcccctgtctccagcaggctgcaatattcctttctgcccattgtacagaatgagagactgaggcttatctgaggtgatctgttccccagccattcagatggtgaaaatagaccttactgtcacccagccaccttctccgacagtgggtgcctcaactctgggcctcaggattggagagggagaggtgatagaactggatggtcctggctagatctgggaaaccctgggttgaggaggaaaggctgcttgaaggaggggacactagagatagggcgttgagggatgtgtaggagtttgggaggattttcagcatctagcttgtcttggttatctcttttgccggttgggcctctgagggcagtaggaggtccctggggaagaggccctggttattgcaggtcatgtgggagaaacagagtgacaaccggccaaccaggccctgcctctcacgtggtctgatcccctggggaggacaagggaggatggggcagcaggtccatgacccagttacaagctgtttgtcttcctgcctctgtaactagccggggtcaccactgacgtgggcccccacccctgcccgcctccctggcacctgtccccggaaagggcacagagaaggggaggaacatagagaagggagggacagttagggaggaggaagggaactcagatctacgaggggccagatgagaaaaggaattaagaggagaggggaagtggggagggggaattcagagagagaggggggttggggagagaaggagttggggggacagtgatccctgcccccatcatggatgcctcccctgtcccttccagcagcctcttatcacagccccagtaagcgccagagcttgggtggcagccacggccccagctggacaacattgtccgggcctcctgcccgcctggcatctcctccacaggcaggtcctgcgcctctatgggtcctctctgccgcgtcccactgtgccccccaccacccccactgcccggcttccctggccagaccatctgggctctggtcccagctctgctgaccggctgtgtgaccctggacaaaccactccccatctctgggtctcatccagtcaggggcagggacgagattggacagggcctgggccgggccccctccacctcccctttgccttagcaggttggctggggaagcgggggcagcggaaaagggccctgaggtccggtccccgccgcagctgttacggtgactcacgctttgggggacattggggtgggggagcttcgctggtacaagctgactctggtctcactgggtggggaggctattttcagagcctcagtaataggtgaaatctgatgtcctgcccctccccccgaagcaccccacggccggaggtggcccaaggggacgtggagcacagagcagggagggtgatctggcagcagctgctctgcccatcccggcctggaaatgggaccgagtccagccacatccgctggcacacacagtgggagtccagggtcaacgtctccctaccttcctgagaccccaatcttacagagaacaggctgttctgagaaagggacccgtggccttccagggggtcagggccctgattcttatcctcacaccggccctgagaccctgtgggacctcagccaggtctccgcccctctctgagccttagtttccatgccacagaacacggagcggggcctcaggctgttccctgcttcctggaagattgtctgcaatcaaaatgatcatcgcagcaatcgcgtccatagtaatgaaaataccccagcatcttagaggggccgaggcgggaggatcgcttgagcccaggaattcgagaccagcctgggcaacatagcaagacccccatctctactaaaagtacaaaaattagctgggcatggtggcgcacctggaatcccagctactcgggaggctgagacatgagaatcgcctgaacccaggaggcggaggttgcagtgagctgagatcatgccaccgccctccagcctgggcaacagtgtgagacactgtctcaaaaaaaaaaaaaaaaaaaaaaaaaaaaaaaggaaagaaaatagaaaatatcccagtgccttaggaggccgaggtgggaggatcacttgagcccaggagtttgagaccggccaaggcaacacagtgagtgagactccatctctgcaaaaataaaaattagccagacatggtggtttgcacctgtagtcccagctactcaggaagctgacgtgggagaatcgcttgagtctgggagttcagggcccaagtgacctaagatcgtgccactgcactccagtgagacgcctgtcttttttatttatttatttatttattttgagacggagtctcgctcttgttgcccaggctggagtgcaatggcgcgaccttggctcactgcaacctctgcctcccgggttcaagtgattctcctgccttagcctcccgagtagctgggattacaggcgcctgtcaccatacctggctaattttttgtgtttttagtagagatggggtttcgccatgttggccaggctgatctcaaactcctgacctcagatgatccacccacctcggcctcccaaagtgctgggattacaggcgtgagccaccacaccaggctgagacccccatctcttaaaaaaaaaagtaataaaaatcacagtagccccagcactttgggaggccgaggcaggcggatcacgaggtcaggacattgagaccatcctggctaacacagtgaacccccgtctctactaaaaaaaaaaatacaaaaaattagttgggcatggtggcgggtgcctgtagtcccagctattcaggaggctgaggcaggagaatggcgtgaacccgggaggtagagtttgcagtgagctgagatcgcatcactgcactctagcctgggtgacagagcgagactctgtctcaaaaaaaaaaaaaaaaaaaaaaaatccaatagcaatataagttgtaatgataacaatcatcgcatcattaataacaatgtagtcctttgagagctggggggaggaaaacagctttctgtgctaggaagggatcacccctgtccgaaatgcccagcccagcctggtcaaggcagggagatggaaaggcagttttgcttctctttctcttcttgttccttgtatttattccaccttgaggctgagaaactaggtcccagatgtttttaatttgttttattttattttttatttttttagagacagggtcttactctatcccccaggctggagtgcagtggcacaatcacagctcactgcagcctcgacctctgaggctcaagtgatcctcccacctcagcctcctaagtagctaggactacaggtgtgcgccacagcaactatgcccaactaattatttttgtaatttttagtagagacggggtttcgacatgttggtcaggctgctctcaaacacttgggctcaagtgatctctccacctcggcctcccaagtagctgggactacagacgcgcaccacaaaaattatgcccagctaatttttgtaattttcgtaaagatagggttttgcctgccggccacagtggctcacacctgtaatcccagcactttgggaggcagaggcaggtggaccacctgaggtcaggagttcaagaccagcctggccaacatggtgaaaccccatctctactaaaaatacaaaaattagctgggcatgatagtgtgtggctgtaatagtgtgtgcctgtaatcccagctactcgggaggctgaggcaggagaatctcttgaacctgggaggcggaggttgcagtgagccgagattgtgccactgcactccagcctgggtgacaagagtgaaactctgtctcaaaaaaaaaaaaaaaaaaaaggagatggggtttcgccatgttgcccaggctgggattgaactgggctcaagtgatccacccacctcagcctcccaaagttctgggattacaggcgttagccatagtccccagctgagatcccaaatgctatgcagactcagtttcccttgctggaaaatgggaagaatgggaggggcctccccacacccagacagggagctgggggcctcccactgccccacatttctcttcaaggggctgctgttattttcgtggggaagtcagatgagtgcaggttccagtccacctctgtcccccatggccgggttccccctcaaggcctcagtttcctcatctgtagcatgggtgttgtgactgccctcagacaccaatttgtcatgatttgggagtaggttgaagtcccagctctggcccagtctcagcgccttcccagccctcggattttccatctccagggtgggtctgcagggaacggggtggcccctctccccagttctgaacctttgtggctgagcgtctgcttctctggtctgtttctgtatcagcacagtgggttcatggaaaggggaaaggagggagaggactccacccgggatttctcctccctctgattaatcctggtgcacttgaatctcttatcttttgatgcagaaatccccccacccttccagcagccctcaacctccaggcgggcctagtgtctgcctgtggatctcagccaggcctgtctgtacatatgctctgtaggaacaagctttcgtagtcattttttgtttttttgttttttgttttcccaagatggagtctcgccctgtcacccaggctggagtacagtggagtgaccttggctcactgcaacctccacctcccaggttcaagcaattctcctgcctcagcctcccaagtagctgggattacagtcatgcgccaccacgcctggctaatttttgtatttttagtagagacagagtttcaccatgttagccaggctggtcttgaactcctgacttcttgatctgcccgcctcggtctcccaaagtgctaggattacaggcatgaaccaccgcgcccagccgggttttttttttttgagacggagtctcactctgtcgcccaggctggaatgtagtggcgagctctcggctcactgcaacctctgcctcctgggttctcctgcctcagcctcctgagtagccgggactacaggcgtgtgccaccatgcccagctaatttttgtatttttagtaaagatggggtttcactatgttggccaggctggtgtcaagctcttgacctcaagcgatccacctgcctcagcctcccaaagtgctgggattacaggcgtgagccactgcgcccagcctcatttttcatttttttttatttctttctttttttttttttttttttttttgagtcaggagtcaggggtctcactacgttgtcacccgggctggagatcaatggcgcaaccttggctcactgcagccttgacctcctgggctcaattgatcttcccacctcagcctcccaagtagttgggactgcaggtatgcatcacctagctaagttttgattttgtagaaacggggcctcgctatgtcatccaggctggtcttgaactcctgggctcaagcagtccacccactgtggcctcccaaagtgctgggattacaggtgtgagccaccatgcttggccgccgaccctagtttttttttgttttgttttgttttttgagatggagtcttgctctgtcgcccaggctggagtgcagtggcgcaatctcggctcactgcaagctccgcctcccgggttcatgccaatctcctgcctcagcctcctgagtagctgggactacaggcgcccgacaccacgcccggctaatttttttgtttttttttcagtagagacggggtttcactgtgttagccaggatggtctcaatctcctgacctcgtgatctgcccgccttggcctcccaaagtgctgggattacaagcgtgagccaccgtgcccagccttgttctttttttttttttttttttttttttgagacagtgtttcactcttggcacccaggctcccaggctggagtgcagtggcacaatctgagctcactgcaacctctgcctcccaggttcaagcgattctcctgtctcagcctcctgagtagctgggattacaggtgtgctccaatatgcctggctacatttttttgtatttttagtagggacggggttttgccatgttggccgggctggtctcaagctcctaacctcaggtgatccacctgcttcggtctcccaaagtgctgggattacaggtgtgagccactgcgcccaggctttttttttttttttttttttttgtgacagtcttgctctgtcgcccaggctggagtgcagtggcaccatcacagctcactgcagcattaaactcctgggctcaaatgatcctcccaccccagcctcccaactagctgggactacagttgcaaaccaccatacctggctaatttttgtttttttgattttgtttgttcatttgttttgtagcgatggggttttaccatatggctcagactggtctcaaacttctgggctcaagcagtcctccctcctcggcctcccgaagcgctgggattacaagtgtgagccattacacccagcccaaccctagctgcaataggcagagaataggtccctgacatctttgttctcccaacctcagttttacccgtctgtacaatgggttgtccatgagcctccacctggcccccttagcttgctccatctgcatgctggggttcaacataggtcctccacggctgggcatggtggctcacacctgtcatcccagcacttggggaggccgagagccgaggcgggcggatcagaggtcaggagatcgagaccatcctggccaacatggtgaaaccccatctttcctaaaaatacaaaaattagctgggcgtggtggtgggcatctgtaatcctagctactcgggaggctgaggcaggagaatcgcttgaacccgggaggtggaggttgcagtgggccgagattgcgccactgcactccagccttagcgttaagagcaagactccgtctcaaaaaaaaaaaaaaaaaaaatgatcctccacaaacttccgccttgatttgtgcctctcacatagtccaagtctgtttgctcatctgggcgatgggttcttgcaggtccctgataaacttctcctgggtcccccgggccttttgcgtgcctccggcggcgtgcacgggtccgcagcgaccccctgcccacctctgcccagcccctcccactctgcgggtctgttcagggcccctccgacctcagccttcggggccgggcagtgggtccgccctctgcgtccctggcgctcctgacctctcgcctctccggcctgcaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgaggtgaggtgtggtggcctgagcggagcggccagcggggagggtgtctgatggtggtgacacggggccaggagggcctgagggaggaggccagtgcgtgtgggtatgatgtggtggtctgagaggggaagtgggccttggagagtgcccaatgggggcgacacggggcacggagcatctgagggaggaggctggtgggtatagatgtgatgtggtggtctgagaggggaggcgagtctaggagaatatgtaaagtaggtgatatggcacaaggagagtctgagagaggaggccagtgcatatagatgtgatgtggtggtccaggcagggcagcaggcctgggagagcatctgatgggggtgacatggtgcaaggagggtctgagggaggaggctggtgcgtgtagatgtgatgtggtggtccaagcggggaggcgggcctgggagagcgtctgacgccgggtgacacggggcaaggagggtctgagggaagaagccagcatgtgtagatgtgatgtggtggtctgaggggggaggcaggcctaggagagcgtctaatgcaagtgatatggtgcaaggagcgtctgagggaggaggccagtgcatgcagggcccagggtggctgctgatgggatgtggaggtcagatggaggaggcaggcctagcagaggtctcaagtgagagatggtacaaggaggtttttttgacagaggaggcaggtgggctgtggcgctccaatggtagaggcaggatctcaccctcacgtctgagggaggaggcaggaaggcccttgaggtctcagggggatgagaatgtcctagatggtcttgggcacaacggacggccttgctgggagcaggggtgaggagaggagagggacaggccatcccagccctccgaggagagccaagagagtcctggcaccgctttctgtgaatgcttgttggttgattgactctcagaccatgccagcagaggcctgatgagcctggccctgccagaggggtgtttgccggtggtcaaatgcctgatgttgagaccagctagctctgtggggttgaggaaatccaaggcggcttcccagaggaggaggtgcagctgagctcagctctgcaggatggccaggccacagtgaacaaggagatgccccaggggtcctggcaggagcgtggagatgagaggcctgatgcctgtgcctctggtcccggtgctaagagcagggttggtcctgcagcttcttggctgcgtggccctcttggacttcagtttctcttgcctgccaaatggtggagatgatcagtctgtagctggatggggctatgggaggttccagaagatcatgcgtgtagccacgtgcgaggtgtcagctgcatcccaagacctgagtgggtgcacagcacacccctgccatgcccatccaggccgtgtctggagcacgcgtgaacccccacacacccaggggctgccagagcatgtgggatgggtgtacgccagacgcagacccacacaggtcaccagcccagccccagcccaggcagcactctatagaaacaggcagttgcacagcctgagagggaggggcatttgcccgaacaggaggaccctggggccagactgcccatgctccagacacagcccttcttttccccagctgtatggacacatcccttttctgtgcctcagtttcctccttggtgcaatgggagtaacagccatgccaccttctagagctggtgcaagggtgagacagggtcacgggctcccaggctctagggtgtgtggaaagacagcagggcagagttacccagtgtttttttttttttttttttcctggagacagggtctcgctctgtcacccacgctggagtgcagtggtgcaatctcggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggcaagagccactgcaccacaccagttacccagtcttttttttttttctttctttttttggagatggagtttcgccctgttccccgggctggagtccagtgacgcaatctcggctcactgcaatctccacctcccaggttcaagcgattctcctgcctttgcctccccagtagctgggcttacaggtgactgccaccacgcctggctaatttttgtatttttagtagagacggggtttcaccatgttggccaggctggtcttgaactcctgaactcaaacgatccactggcctcagcctccccaagtgcggggattacaggcgtgagccaccgcgcccggcagttacccagtcttgatcttgattctttgaccttgaccttagcatctttctcctcccccacccccactgatgagcaacaaacctgctggggttggctgtgagggggcactggggacggtgggggcagagaggtgggccgggtgactgcctgttgggagcaggggccaccgtggggacggaggttctcatcgtcacacagggccagacctctctgccaccacacatcttcctcgcccggggccccgcccccacctcctccgtgctgagctgatacaattttgaagcgagcttttctgctgcagtcagcacaacctctgggcgcctccccacccccaccctgcccctcccgcctctgctcagcaggcaggcctgtgccccaggtcaggttggcctctctgagtgaaggctgcaccctcccttgcccccagcctgcccccttcatccccaagggaatccctgcttcaattggccccagcaggccacaccctcccccaattggccccagcagggcacacccccccccaaccctcccacctgcccactgcgggtgctccagctcctcatgggggtaagagctgggcctggactccaaccccagctcagctgcccactggctgggtgatgtggggccagtcactcaccctctctgtgcttcatttccttgtctataaactggggggctcaaaactggttgccttgtgggaaatgtcaagtgcccagggtgagagctcagtaaaccacccacaaggcatcgtgaagaccaggcactaggcagggggctagggcccttggtggttatcgttactaacattatcctcttcgggattggtttgtttgtttgttattattggtttgggttttttgggggtttttttggttgttgttgtttttttttttttttttgagacagactcttgctctgtctcccaggctggagtgcaatgacgcaatcttggctcactgcaacctctgcctcccgggttcaagcaattctcctgcctcagtctcccgagtagctgggactacacatgcccaccaccacacccggctaatttttgtatttttaatacggacggggttttgcatgttggccaggctggtctccagctcctaacttcaggtgatccacccgcctcggcctcccaaagtgctgggattacaggcgtgagccactgcaactggccttgttttttgttttttgcagagatggggtatcactatgttgcccaggctactctcgaactcctgggctcaagtgatcctcccgccttggcctcccaaagtgccaggattacaggcgtgaccccctgcgcccggcccatcctcctcattctgattataatctcccactgccagacctttccttatgcattccctggacatagaatgtctttcccatatggaaaaccccaactccggctgggtgtggtggctcatgcctgtaatcccagcactttgggaggccaaggcaggtgactctcctgagctcaggcattcgagaccagcctgggcaaaatggcaaaaccccatctctaccaaatatacaaaaaattagccacctgcctggctgaaaattctttcccattctcacagctgccctgtgaggcaaggatcattgctgtatgccttttttttttttttttttttttttttgagatagggtctcactctgtcacccaggctggagtgcagtggcgcgatcttggcttactgcaacctctacttcctgggttcaagcgattctcatgcctcagcctcccgagtagctgagattacaggcgagcgccaccacacctggccaatttttgtatttttagtagagacgggctttcaccatgttggccagggtggtctggaactcatggcctcaagtgatccgccctcctcggcctcccaaagtgctgggatgacaggcgtgagccaccgcgcccggcctgttgtacgcattttacagaggaggaaacagaggctcagaggagggatttgacctgccgtggtcacacagccgagactgggccaggtgggatttggacccacaagcagcttctgcctctgccctgtccttgacacctgcctcatcctccattattgtcagaaggggatgggcggaagttgtggtgcgtgagggggcagtctgctggcacggtgtggtcaccttctggcagggttgtgtgagggccccacaggctgaggtcttatgtagggtccccaggctgtggctggcctccaggcctcagcgctgatcccagtggttgtcaccctgacagcaggaagactggccaccggcttccttttccgaaccgagagtccccttggctgtggagcgtcctggcccagccagagtgcagtgtctggctttcatcagccctgctgggcagctgaggccctgggatagagggagagggagggacgggcatcaggcatagggccttggctggcctcttggaggggtgcagggtggatggcggtggaggggcacctgccatggggctgaaaggagccaccacttgcaacgtcacaagtgagagaggaggccgggcacagtggctcatacctgcaatcccagcacttcgggaggccgaggcaggcggatcacctgaggtcaggagtttgaggccagcctggccaacatggtgaaaccccatctctactaaaaatacaaaaattagccgggcgtggtggcgggcgtctgtagtaccagctactcgggaggctgaggcaggagaatcgctggaacccgggaggttgcagtgagccaagatcgcgacactgcactccagcctgagcgacagagtgagactctgtctcaaaaaataaaaattaaaattaataagaagagggtgtcagggaactgcaggaaaataaagcagggagggacatggaggggggctgggggccactctggatggggagggcttctctgaggaggcgtctttgaggtgaggcttgaagggggtgagggagtctggagaggctgggtggagggagcagtgagggggttatagccagtgcgaaggcctggagcccaggagcagcacatggagctggctgggatgttcagggggtagtgagtggcgagggccgtcctgtggccttccagtgagggtgaccagccgggggtggggcgggagagggtgacccgggtgctctccgacctgccacgtgctggggaaggagcctgcaggaaccagggcccagagagggaagctgtctgcccgcccagggcctaaacccagccaggcctccccgccccctctggcagcccaagaaatctgaggcgcgggcgggcaccgtgccagggctgggcgggggaggggctgccaggcccgcccgtcccagcagctgccagcccgccccgagccgccagcccagatggtgcccatctgctgacgccgccatgggccagcctcctgttcccgccttgcgtcgtgccaagctcctgcagtccagcgccgggaatggcgcggtgggcagagcccggcccgggaagctcatagcacgccagagaggctgccccgggtgccctggagagggtggcaggagaaacatgggagggggagttccccagcgcttcctggatggaattggggagcaaggaccccaacagcgataatgatggcggcaaacacacatggcgtgccctctgtgtgccaggctccgaggccaccgctcaccctaactggtttaattctctcccccatccaagcaggaagggactttggccttctctcgtgttctagtggaggaagcagagacccagaggtttggacaagagtcacttgtccaaggtcacaaagctcctcaggggcagagccggaatgagaatccagaacccctttgaaaaagggattgaggccaggcgaggtggctcctgcctgtaatcccaacactttgggaggctgaggcaggaggatcacttgaggccaggagttcgagaccagcctgggcaacatagcacgaccatgcccccccccaacaaaatttttaaaaatgagccaggtgtggtggtgtgtacctgtagtcccagctactcgggaggctgaggcaggaggatggcttgagcccaggagttggaggttgcagtgagctgtgatcccaccactgcactccagcctgggtgacaaggcaagaccttatctctaaaaaccgttttttttaaggggtgattgaggccaggtgtggtggctcacacatgtaatcccagctacacaggaggctgaggcaggagagtcgcttgaacctaggaggcggaggttgcagcgagctgagctcatgccactgcactccagcctgggcgacagagtgagaccctgtctccaataaaagggaggtggtattgaaaccccttaaacctcttttcaaaaacaaactaaaagtgccctttgaggttatctagtggaagccacaccctctgagtcatacagatcatacagtgcaggccgtgcacactcagggagtaaatgaatgaatgaatgaatgaatgaggtgaaccctatggaaggggaccaagcctggggccagggtgtccataaagctcaccctgagcttgatggcaggagaaagggtctcaacctgggagtgagggacctgggtcagccacagtgctgccctggcttgctgtgtggctttgagaaaagtcctgccctctctggtctggggttgaggggagtggagggtgggaaggggcggccttgtgggccacagacaggagcaaggcgggtcttcactgaaagcctcccgtcctcttctgcctttattgatcttcatcccggttgtgggtgctgcactggggagacaggccatgagctcgggtgacggtgcctgtttatttgtatggtggacagaatttgtgttcctgtgtgctccaggcagtgtggggcgcattcttctctttgagccttagtttttgcctctgtagaatggggagaatcagagctgtgcccattgcattaaagattggagtcagtggtctctgagaagcatacaggaggcactcaataaatgctcacttccggccgggcgcagtggctcacacctgtaatcccagcactctgggaggcccaggcgggtggatcacctgaggtcgggagttcgagaccagcctgaccaacatggagaaaccccatctctactaaaaataccaaaaattagccaggcgtggtggtgcatgcctgtaatcccagctagtcaggaggctaaggcaggagaattgcttgagcccgggagaaggaggttgcggtgaaccgagattgcgccattgcgctccagcctgggcaacaagagtgaaactctgtcccaaaaacaaaacaaacaaacaaaaagaatgctcatttcctccctggattctctccccaaccccaggagggaaggagggaggtcccagtgccgccgtgaaaccctacacctccttttcccaacccagtgagccagtgggggcaccgtgacccaggagtggctgtcaccagaagctggaccaagtcaccctttccaggtgtctggacagcagaggggtgaggggttcctggcagcagcagcctgttatcccccagggctgggcagccaggtgtgccagccgtctgtctgtgcagagaaggtggctgccgggcgtgagtcgcagacgccagctgatggtgtatttatagcaacggcaggagtccgcggggcatacgtcagtggtaaagagggacgggcaggtgggggtccagctcccacagcagacaagagcccaccaggactggccagggagctgaacagagtgtcagggagaatgaggggcatgttgtgcagccgggaggcccaggatcacacccctctgctctggaactgcgtgatgtttgacaagtgacattgcagctgtgggcctcagtttcctcccccatcaaatggggatgataataatcctgcccacctaatagggctgcataggatccaattagtgcatgaaaagcatgaggacagggcctggtatacagtaagcactcaaaagtgatttgttgcctaaaaaagggagggaatcccaacatgggccacaatgtggatgcatcttgaggatgtcacactcagtaaaataagccagacacagaaggacaaatcctgtgtgattccactcctaggaggtccatagagtcgccagattcacagagacagaaagtaggatggggggtgccaggggctggggagggggctggggagagaatgtttcatggggacggggtttcagtttgggaagatgagaaggttctggagaggatggtggtaatggttgtacaaccctatgaatacgcttaatgctgggttaatgccactgaacttagaaatggttaaaagagaggcaggaggattgcttaaggccaggagttcgagaccagcctgggcaacacagcgagacctcatctgtacaaaaaatttaaaaattatctgggtgtggttgcacgcacttgtgttcccatctactcaggaggctgaggcaggaggatcgcttgagcccaggagtttgaggctgcaatgagctatgatcacaccactgcactccagcctgggcgacagagcaagacttgtctcaaaaccagaaccacccccaccaaaaaatggtaaatttatgttatctagattttaccacaatctaaaaatgtagttctggttgtgaataatgataataacaagtaataatattatatctatggccggctgtggtggcttacgcctgtaatctcagcactttgggaggctgaggcgggaagatgacttgaggtcaagaattcgagaccagcccagccaacatggtaaaaccctgtctctaataaaaatacaaaaattagccagtcgtaggccaggcgcggtggctcacacctgtaatcccagcactttgggaggccgaggcaggcagaccacttgaggtcaagagtttgagaccagcctggccaatatggcaaaaccccgtctctactaaaaatacaaaaattagccaggcatggtggcgcgtgcctgtaatcccagctacttgggaggctgaggcaggagaatcacttgaacccgggaggcggaggttgcggtgagctgagattgcaccactgccctccagcctgggcaacagagtgagactccgtttcaaaaaaaaatgttatatatgtaacaatgtaataattagtaatatgtcatatataatcatggaacaataaataagaaaaatagtgtctgcggtgacagcacagtagttattattgtcgttatcatgatcgtcatcactgtggttctcgtccagctctgccctgcagacagctgtgtaaccctgggtgagtttcttgccagctctgtgctttactgcctcatctgtgaattgagcatagggggtgcctagcaatttaaatgagataatagctcttttttttttttttttttttttgagatggagtcttgctctgtctcccaggcaggagtgcagtggtgtgatcgtggctcactgcaacctccacctcccgggttcaagtgattctcctgcctcaacctcccgaatagctgggattacaagctcatgtcaccacacccggctaattgtggtatttttagtagagcgggggtttcactatgttggccaggctggtctcgaacttctgacctcaggtgatctacctgccttggcctcccaaagtgctgggactacaggcgtgagccaccgcacccggcctaaatgagataatatctatgaaaaaactaaccctttgcatgtgatgagtgctgggaactggtaggctctttgaggagtaggtcctcccaccaccccgcagacgcccctacccagcagaatgctggtttctgcatgaatgcatttgtgtggggactcccgagacagcccctgagggagccctcattcacccgggtggggcccggccctcccagagccagtgggagggggaggcgccttgttgcacctgtgatgccccccgttatggctgggctgcagttgtcaccctggccctgtgcctgggaagccaaggggaggctgagggcagctagggacagctctgtgcccacggccccctccagccagctgccaggccagccccctccctccagctgggcgagggcaggaagtcacagatggtcagggttggtgaggggtgaagcagagggcatttggggacaccggatgtctcgtccagatggggaaactgaggcccggagaggggcgaggcattgccccgagttgcccaggaagggccttggctcttgtcccttctaagtcccatctttatttttattttttattttttggagacggagttttgccctgtcgcccaggctggagtacagtggcgcgatctcggctcgctgcaacctccgcctcctgagttcaagcaattctcccgcctcagcctcccgagtagctgggattacaggtgcccgccaccacacccagctaatttttgtatttttagtagagatggagttttaccatgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagggggttctgaggggaggaagacgcgagaatctcaacgctgaagtggtttctagattctccagggcatgagtcctgaaatccccaaggcctgagttctagaatttcttccactggggccctgaccacacaggtgattctagaattctcctaggtgagttccagacccaggggtccaggagaaatagaatgttggctgggcgtggtggctcacacctgtaatcccagcactttgggagaccgaggagggcagatcacttgaggtcaggatttcaagaccagcctgaccaacatgatgaaacccggtctctactaaaaatacaaaaatgagccgggcgtggtggcgcgaacctgtaatcccagctactctcaggaggctgagacaggagaatcgcttaaacccaggaggcagaggctacagtgagctgggatcgtgccactgcactccagcctgggcaacagagtgagactctgtctcaaaaaaaaaaaaaaaaaaaaagagttccaaccacacatataatttaacatttttctggtcctcacacttaagaatgtaaatttaagtatactggggaaattaattttaacattattttaagtaatgttaattttttttttccttgagacagagtctcgctctgtcgcccaggctggagtgcagcggtgcaatctcggctcactgcaacctccacctcctgggttcaagcagttctcctgcctcagcctcccgagtagctgcctcagcttcccgagtagtaacattaaaatgtttaattttaacattactttatttaacccagggcatctggaatgatactattgcaatccataaacaacaggaaaaattattggtctattggtcgggtgcagtggctcacgcctggaatcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtattttatgatcttttccccacccaccccccacccgcttacactaagtctgaaatttggacagaccacatttcaagcactggatgtcacacgtggccaggggctgctgtattgggcaggccgtgctaagacatctgagttccagagcaggggttcccgacccccgggccacagacgggttccgtgcctgggaggaacctggccactcagcaggagttgagcttagggcaagtgaccattctcacctgagctccacctcccgtcagatcagcgggcggctctgggtgcccctacgagcatgaaccccatggtgaactgaacataggagggatccaggttgcgtgctccttaggagaatctgactaatgtctaatgtctagtttcatcccagaaccatctccccactcaccccgtccctggaaaaattgtcttccatgaaatcggtccctggggccaagaaggttggaggctgctgttccagagaattcggaagcagatctccagtctcccaagttgggttctcgaaaacgtgagggcaggttctagaccttccaaactggttgcttgaaaatccaaggaggctgggcgcggtggctcacacctgtcatcccagcactttgggaagccgagacgggcggatctcccgaggtcaggagttcgagaccagcctggccaacgtggtgaaaccccatctctactaaaaatacaaaaatcagccaggtgtggtggtgcacacctgtaatcccagctactggggaggctgaggcaggagaatcacttcaatccgggaggcagaggctgcagtcagcagagatcgcaccactgtactccagcctgggcaacagagtgagaatctaactcttttgcccagactggagttcagtggtgcaatcacagctcactgcagccttcaactcccaggttcaagtgatcctcccaccttagcctcctaagtcgctggggctgggattacaggcgcataccaccatggttgattttttttttttttttttagtagagatgaggtctcactatgttgcccaggctggagtgctgtggtggactcatagctcactgcagcctcaatctctcaggctcaagggatcctcctgcttcagcctcccaggtagctggcagtataggcgtgcaccactacgcctggctgattttttatttttatttatttatttatttactttttgagacggagtcttgctttgtcacccaggctggagtgcagtggcgcaatcttggctcactgcaacctccacctcccgggttcaagcgattctcctgcctcagcctcccgagtacctgggattacaggcgcgtgccaccacaccggctaatttttgtatttttagtagagatgggatttctccatgttggccaggctggtcttgaactcctgacctcgggtcccaaagtgctgggatgacaggcatgaactaccatgcccggccttatttttatttttcgtagacaggaggtctcactatgtggcccatgctgggatttcaggctctttgagctttcttccatattggttagggctggagcaggactccactgtggcgggaggtatttgggcgcaaggagagcagttgtgaggactggtggtgacccccagttactgtctgttgtgctttggatgctgggcacgggaagcctggctgtaagtgtgtgtttccgggccgggcgcggcggctcacgcctataatcccagcactttgggaggctgaggtatgcggatcacgaggtgaggagatccagaccatcctggctaacgtggtgaaaccccgtctctactaaaaatatgaaaatattagccaggcgtggtggtgggcgcctgtagtcccagctactcgggaggctgagagaggagaatggtgtggacctgggaggcggagcttgcagtgagctgagatcgtgccactgcactccagccggggcaacagagtgagactccgtctcaaaaaaaaaaaaaaaaaaaagtgtgtgtttccaagaggctgttatggggcctcgggcacaccctcactgggtctggatcccagcctgtctaccaccaggcgtcccttctggtgaacagagctatgtgagaacttccaacagggacaccacggccgctcgtagcccagagcttgcagagctttgttcaaaggcaatggcccagggccgagcacggcggctcacacctgtaatcccagcacttgcagaggccaaggtgggtggatcacctgagatcaggagttcgagaccagtctggccaacatggcaaaaccctatctctactaaacctacaaaaattagctgggtgtggtggcacatgcttgtagtctcagctactcgggaggctgaggcaggagaatcgcttgaacccaggaggcagaggttgcggtgagctgagatcgcgccattgcactccagcctggtgacagagtgagactccatctcaaacaaacaaacaaacaaaaaagcagtggccatcatgatcggttgtgtcatctagtgggaggcaggggtgtgtctgcatgcgtgtctggggtgcattgtggggggattgcaggcgtattgagggcttaccaagtgcctggctcatctgagccctcaggaaaccacattgttggcagctacctcaccgtctcacaaccacccgctgaggttggaatgatcattaacagcatttaacagatggggaaactgaggcctagagaggcaaagtcactggcctaaggtcacatagctaaggagcacagtcaggatttaaatccaagcctgggagatcccaggacccacagtgggcaccacataaaggggctgtttggggtatggcagggactgccctggaacgttccggatcctgcctttgggcctacagggctttggtgccggtgagcaggccgcaggttcagctggctcaaggagcagcttcagggctgcagccaggctgggggctgggcaggtctcaaacccctggacctggggaatcagggaggtgtgagctgcatctgaggtcgggtgtctctgtgactctgtctctgtctctctacctctgattctccccaggctgccttgtctcagtccctgtctattcccaccccacctcgctctctctcccggccttgcgagtctcctcccagccccccatcccacccagtgggctgcccggaggtggcggcaacggggcagctgaatgggcctcttgttcctggccacacccgccccttggggtcaccctgggacatgcccaggcagcgtggctaccttaaagggccagtgctcagaaagaatgtgagcgggggaggctgcgtccactcccaaatcccacaccctccccaaggtggaccactcatgtgtctgacgggggtggggagctgtgtacctacacaccctcgtggcttgggggaggcctgtctggagcaggagatgtgatagggtttgggtttgaccttggataaatcccttcatctctctgtgcctcagtttccccatctagatcagggggctccttggtgccacccctgtgggttgctgggcagatggcatattatccaggattttgcacacagttgacactcttccggcgcccactgtgcattgatagagcacctgctgtttcagcccagcattcatccgccgtgcagacttggcaattccttcttcaccttgctccgtgcctcagtttccccaaatgcagaatgaggcgatggctgtcttagcttcacagagagctacgcaaggattgagtcggttcgtggaattagagggtattagggagaagggcctgaaacactgccaagtgtcacctccactggcgcacttattgagcgccagctgcataccaggccttgctgaggaagcctcactgcagaggttgcagtgagctgagaggcaaaggccacccagcctggatctcactctggtgtcatcgcctcctccctctgctcagggttgtgcagcttcaggctgctcccctgccctctctgggcctcagtttcaccttcagagcaacgggaacagccccatcctttcacacactggaaaccatcaccttcttctgcctgggagggggttgtgctgtctctgggaatcccaggcatcccccaggcaggagtcaacccagaggccctcggacccgggctgtaccctgtgacagctccgggtggctacgacgctcccgtgctccaggccagccccacagacagcccgggacaggttgctgccggatggacaagcctgtgcctcgctgccttatgtaaccagtttatgcaagggcagccggcccgcttacataaggggaggccgggccagcgcccagctggggagggggaggctcttaaagggaccggcgtcccccgcggctccctccacgggcactggtgcgaattcataggcgagctgcggactccgccctcagcaaggccgccattaatgtcgttatgattatttttgtggatgttgtttatcatcactatattctttccccagggcgggggttcagctgagcggaggaccacgcccagtgcttgggcagaggcttgggctgtgacgctggctctgggtgtcacctggttaagtccctgtctctgagcctcagcctccccttctgcacagtggggcaatgcaggaagacgtgaggtcctggagggtcctggccctgctgcctgttcactgtgtggcctcaggcaggtggcatcccctctctgggcctcagtttccccatctataaaatagcgcctgctctgtggggttgctgagggagagtcaataagacatattaagagtttacatgcccgccaggcatggtggctcacacctgtaatcccagcgctttgagaggctgagacgggaggatcacttgaggccaggagttcaagaccagcctgggcaacatagtgagatgcccatctctacaaaaaataaaacttagccaggcatggtgatgtgtgcctgtagccccagccactcgagaggtcgcggcaggaggattgctcaagtctgggaggttgaggctgcagtgagctgtgattgggccactgcactccagcctgggtgacagagcaacaccctgtctcaaaaaataaaaataggccaggcatggtggctcatgcctataatcccagcactttgggaagccgaggaagacagatcacttgagatcaagagttccagaccagcctggccaacaaggggaaaccccgtctctactaaaaatacaaaaattagctgggcgtgtggtgggagcctgtaatcccagctactggggaggctgaggcagaagaatcacttgaacctgggaggcggagattgtagtgagccgagatcgtgccactgcactctagcctgggtgacagagcaagactccatctcaaaaaataaataagtaaataaaaataaaaataggctgggcacagtgactcacacctctaatcccagccctttgggaggctgaggcgggaggatcgcttgagcccaggagtttgagaccagcctgggcaacatagcaaatctctgtctcaaaaatttttgaaaacaaaagagtttaggacagcacggagcacagacactgtcagcactcatccagtggaaccactttgcagccaataaatatttagtaagctcctactgtatgccaggcactgctccaggcgctgggatactgcagtgaacaggacagataaaaattcggccctggccaggcacggtggctcacacctgtaatcccagcactttgggaggctgaggtgggcggatcatgaggtcaggagatcgagaccatcctggctaacatggtgaaaccccgtctctactaaaaatacaaaaaaaattagccaggcgtgatggcaggtgcctgttgtcccagatcctcaggaggctgaggcaggagaatggtgtgaacctgggaggcggagcttgcagtgagccgagatcacgccactgcactccagcctgggtgacagagtgagactctgtctcagaaaaaaaaaaattctgccctcgtggaactcacagtttggttcaggcgatgggcaaagaacaagaaataaatgtcagtttaggcttagtgcggtggctcacgcctgtcatcccagcactgtggggggccgaggcgggcagatcacctgaggtcaggagttcaagaccagcctggccaacatggtgaaaccccgttcctactaaaaatacaaaacattagccaggcatagcggtatgcgcctgtaatccagccactggcaggggctgaggcaggagaatcgcttgaacccggaaggcggaggttgcagtgagccgagattgtaccactacactccagctggggccacagagcgagactccgtctcaaaaaataataataataaaaataaaaagaaataaatgtcagtttagcgataaggactatcaagaaaaataaagaaggccaaaggaaaagaggctgatgggctgtgctggggaggtccctgaaaggctgtctgaggacctgacatttgagctgagacctgagaagtgaggaggaaccagttatatgaagaactgggggaaggcgttccaggcagagggcacagcccgtgcaaaggccctgcggcaggacacacctggcactttggaggaacagtgaggaggcctgtgtggctgcagcagagtgaggagaggaagagaaggaggaggggagggcagtttgtgcaaggcctggtgggcagtaggaaggacttgggctttgaccccaaggcaggtgggagccatagagggctatgggcagaggagggaccagccctgactcaggtgctcacaggcaccctctgcctgctgcagggaggacagactgtggggggtgagggcaggagctggggaccagggcagagtggaccgccctggtgcaagcaggcggtagcagggacagaggcagaggagggggcagaatccaggtcaactccgacggtgtgaggattcagttgctcacctgggtcgtttataccttatctgaggctggcccttgctctccttgccccgtctcctgcctgcaagccgcacctgcctgggcacatgcagggaagggagcggcgcagcactgggcacgcctgggagctctcctgcaatcaggactttgttagcgggcaagctgggatatgggtcctggtgcccgggaggcccgtggggctctgggctcctgccagggtcccagccctaacccaggtacgccacccacatggcagggttattctctttttttttctctttttttagacagagtctcgctctgtcacccaggctggagtgcagtggtgcgatctcagctcactacaacctctgcctcacaggtttaagagattctcctgcctcagcctcctgagtagctgggactacaagtgtgcaccacctcacccagctaatttttgtgtttttagtagagacggagttgcaccatgttggccaggctggtctcaaactcctgaactcaattgatccaaccgcctcgacctcccaaagttctaggattacaggtgtgaaccaccgtacccagcctattctcatttattttctttcttatttttttttcttttttttgagacgaagtctcactctgtcacccaggctgaagtgcagtggcacgatctcagctgactgcaacctccgcctccagggttcaagcaattctcctgcctcagcctcccaagtagctgggactacaggcatgtgccactatagccagctaatttttgtatttttagtagagatggggctttgtcatgttgacgaccaggcaagtctcgaatgcctgacctcaggtgatccacccagcctcagcctcccacagtgctgggattacaggctggagccactgcgcccagacggtccttccttttcatgcctcctccttccactcccccatgtaccatgtctccttgtctctctttttctctctgctcatccctccctctcaactttctttctacaaatatttattgagcacctagtctgtatcaggccttattctagccactgagggcacaacagagatctagacagacaaagcctctgccctcaaggaggtgacattccactggggagatgagcaaacacccgtgcagtcactaagcaactaagcaaatccataggcaatcactaacttcctctgaaggaaagaaaacagaaggctgagattgagggtagccagaggctgcttgaggtgaaggggctcagcgtagacctctctgagaagggagcatttgagctgagaccaggagagatctcaagagagagcaagcagttagctgtttagacagagggaacagaatgtgcaaaggccctgaggcaggactgggccaggtgcattggaggaacagcgaggaggcccctgtggctggagcagagtgagtgagggggagagagggaagaggggagggcagaaagcggacaggacaggttgtgcagggcctgtggtcctagtcctccactttgactactcccccaaatctcttaatgttcctcacattcctttccctgacaagcatttattttgcacctgctgtataccagatcctatcaggagaatcccaaatattcatgcaacaagttcatattgggtgcctactgtgtgccaggctctgctggaataatcacactcatttggctgcaggcatttattgagtgccagctgtgtaaaagcatttatcgagcaccacctgtgtagcaggctctggggagagaggccacatgaaagcttgggaaggagaaagtttccttctaccccctttcaggtttgtgccctctggtttccagccccctcccacattcaaggcaacatttaaacctctgggttcaagttccgttgtccaactgcgtggccgtgagatctgcggcaagccccttcctctctcggatcttccgtttccccctttgtaaagcagaacactccacaatctgatgtgtttacaacttgacatctactttttgcagcaagggaaactgaggcacagagcagggcggagatgtgtctacctctccctccccaagcaagactggcatggagtctattctcctgaccccacgccaaagccagggcgtttggtattttgttttttcttggaggcccagagaggggcagggcttgcctgaagccacacagcaccgggcaggcctcggaattgcggagagccctcccctgggcgcctgcccgggctcccgcgccttcctcctgcctcctttggctgggccgccagccttgcctcccgtcctccggactccccgcgggctgcccagttggagacgcgccccaagaaatatcagaaggaaggggaagccgggaggggcctccgcctcctcccgccaccccccgccgcgcccggctgcccccacccggtgcccgacattggcagagagtgtcctcgggcgcttccgactggccctgcctgcttcgtgtggccactgatcccttccggagcctctccatggggacgcccgtgtgtgcgctcagccagtggcacatgtggctcccggggctcccttctccacccccccagcccctggcctgcccctttccccccatcccttcccgaacctctccatggggacgcgtgcgtgtgcgttcagcccgtgggcacatgtggctcccagggctccccccgaggcctgcccttctcccccccccgtcacagccgccgagtcaggcctgccaggaaggtgttgggggtgggggtgtggggaggcctcagcttggctgctgggaagccaagaatttgctccaaatgtaaacagcgagttattttcagtccactcccccccaccccgggtggcgttgacacatttgacattggcgggaccgggagggggtgggggtgagggtgtgcgtgcgggtatttttaaccttgctcctcacatccctggagtggctggtgccgagtggcagataatggggagggggcgcggaggcgtggggagccctgggtggccgtgcgcgggtgggcgcttggcaaggccgccctgctgttggcaccacgtgtttaacccctcagaggctgcagaggggctgggggaggcggcccagggcccagtggtgccccagaggctcccttgtcaccttctcctggtgtccccccacccccaccccacccaggagggcagggccgggtgcccgaggccggtgccagcctgcgccgcccagacctacaaaatggccgccaaggccggagaaacatctggaacaggggaagggagaggcgagaaaatggccgccagagggatgatgtcatgggcggcgtggcctcccagagcgtccccagcacggggcgagtccctacgcgcaggcctccgagcaggggccctgcggcctccagggacctccagacccgctgcccaggccggacacccacaaagagtgacaccggggtccccaggggtccccagaggcgggcccgagacctgggggagggcgaggccagcactgggcctccagtcccaacagcccgatgctggggacggttccggggcggtggtggccgctgacctgacccgcaggacaccgaggcgtccaccagcgcccgggagggcccggagccaggccatggagccggcgggggccgggtggaaagaaaaaagaaacttttctttgaaagtgattccgaagcaggttggctccggcccaggcggcccggcggcaggggagagggagatggaaagtatgggccagacttaaggaacgcaggaaggacgaggccggggaggcccgggatggaggccagcgtcctggaggtcaccccgtccacgcctctgcctctcgggcccccccaggtcacatccagattttcctccctgtccctggggcgggcggggagtgcggagaacatctatgggcttgtgttttttcctcttttgatttgtccagacaggcgatggacaagggctgggcaggggttttaggtcatctgcactgtcaggatgtggaggctcagagagggagagtgcttttagtgaggtcacacagcactggcaaaactgacagctgcttccctccttagagcatcttggggaggaggaagttctctatggaggatcagggtccgtactggaattcctttctatttttatttaatttaatttatttatttatttatttatttttgagatggagtttcactcttgttgcctaggctggagtgcaatggcacgatctcggctcactgcaacctccacctcctgagttcaagcgattctcctgtctcagcctcttgagtaactgggattacaggtgcctgccactacacccagctaatttttttgtatttttagtagagacaggggtctcaccatgttggccaggctggtctcgaactcctgacctcaggtgatctgcctgccttggcctcccaaagtgctgggattatacgtgtgagccaccgcgcccggcccctttttctttttctttcttcctttctttttttgaaacagagtcctcctgctctgtcacccaggctggagtgcagtgacttgatcatggcttactgtagcctcaaccttctgggctcaagcaatcctctcacttcagcctcctgagtagctgggaccacaggcatgtaccaccatgcccagctaaatttgggttttgtttgtttgtttgagacagagtctcactctgttgcccaggctggagtgcaatggcacgattttggctcactgcaacctccacctcccaggttcaagcgattctcctgcctcagccttccaagtagctgggattacaggcacccgccacgatgccctgctaattttttgtgtttttagtagagatggggttttgccatgttgcccaggctggtctcgaacttctgacctcaagtgatccgcctgccttggcctcccatagtgctgggattacaggcatgagccaccgtgccctgcctatttttttttttttgtagaaatagggtctcactatgttgctcaagctggtctcgaacttctgacctcaagtgatcctcttgccttggcttcccaaagtgttgggattacagcgtgagccactgtgtccagccaatgtctgtgtgtttttcactgctctgtccccagtacctaggacagggcatggtacacagtaggcgctcaagacgtgtgttggataaaagcatcacagttttctcctgaggctggggttggcacagatgctggcacaggaagggggcagaggctcaggaaatgcaaagtaggttgcaacgtaactggacacacacgggaaccctgtggtcacatttttcaggagggatgtgaggaggcgaaaactcaaacttccctcacttcaagtgcagattctgtgccgggagctgtggacgataaaccacatttgaacagaagcctgaataaagcgagagagtgagccaggcaggcatttgcagggacggtgttccaagcagtgtgcacagcccgtgcaaaggccctgaggcaggaccgtgcctggtgcattggtggaacagccaggaggcctgtgtggctggagcagagtgagcgagggggagagagggacgaggggaggaggggagggagggggcagaggcgggctgtgcagggccttgagcgccatggggagatggggagaacttggacttttagatatttggttttctgttttttgttttttgtttttgaggtggagtctcgctctgtcgcccaggctggagtgcagtggtgcgatctcggctcactgcaagctctgcctcccgggttcacgccattctcctgcctcagcctcccgagtagctgggactacaggcgcccgccaccacgcccggctatagttttgtatttttagtagagacggggtttcactgtgttagccaggatggtctcgatctcctgacctcgtgatccacccgcctcggcctcccaaagtgctgggattacaggcgtgagccaccgcgcccggcccaattgtttggttttgtttttgctttgttgttgttgtttttgagatggagtctcgctctgtcacccaggctggagtcactggtgcaatcttggttcaccgtgccctctgcctcccgggttcgagcaattctcctgcctcagcctcctgagcatctgggattacaggcatgcaccaccacgcctggctaatttttgtgtttttagcagagacgaggtttccgccatgttggtcaggctgagctggaactcctgaccttgtgatctgctcgccttggcctcccaaagtgctgggattacagacgtgagccaccgcgcccgggtgaactttcacatatttgtagacccagacacagtccagggtgctggggactagaacaaacgtttgcagaaagggctggggagggtgttccagagaaggagatgtcagagctgggctgcaaagtatggctggaggtttcctaggagggagaggggcagggaagacggcacagcaggagctcagaggactcaggcccaggtcactcgtatattccattgccttccaggacagagaaagttgaaccttcgccgggtaatgtttaaaaatggccggtgacacccagtagctgggaattccagggcctggctttggttctctctttagctggctgaggttgggaggcggacgtggcagccggcagagccagcaacatttggaagccggctaacgttggaaaatcaaccaggcgagctcacggtggcggccgatgctggaaacctgggctccgtgaggtccagcagatgccctgctggggcccaagtggacattctaggccttctgacagcccgccgggtttttaaataagtgtgattatggtttcagcaagtcctgtccttcctacagccaaaagatcaattcaatatggccactccgtgcaatgctgggccacccctgctgggccagggtgttgtgttgaagccaagattcccaacacctgagagtccagaagtttctttaaaaattgctttaactgtggtgagacacacatcacacactttttttttcttgagacagggtttcactctgtcacccaggctggagtgcagtggcactgtcatagctcatcgcagcctcaaactcccaggctcaagcaatcctcgcacctcagcctcctgagcatctgggaccacacatgcagcacgcaccaccacacccagctaatttttattttattttattttatttttgagacggagtctcactctgtcgcgccaactcggctcactacaacctccgcctcctgggttcaagcagttctcctgcctcagcctcccgagtagctgggactataggcgaccgccaccacacctggctaatttttgtatttttagtagagacaaggtttcaccatgttgaccaggttggtctcgaactcctgaccttgtgatcccaaagtgctgggattataggcgtgagccaccgcccctggctgacacccggctaatttttaaaaatattttgtagagatggggtcttgctatgtggtccaggctggtctcgaactccttgcctcaagtgatcctcccacttcagcctcccaaagtgctggaattacaggtgtgagccactgtgcccggcccagagacttttgaaagtctaaaatggattgtatcatagctcacatcactcctcttcccactgcaggataaaacccaggcctctcactgcaacacacaaggccccgaatggtcccgctcccctctccgttcgttcctctttctcttgcccaccacgctgcagcctggggtctgtctctgcctttcacacatccaacttcattcctgccccgtggaccttgcccttgtcaccgaacctttgtggaacgctttcaccccagctctccacatggctgggctccttctcccgctggagagccaccgtcacatcctcagagaggttctgcctgagtcctccctccaacgccgcccccaaagccattctgccttccgccagtttcattgcctccgtagaacctagaaccgtgtgaaatgatctgaggcttcctccatgcactggttctgcccgtctccctccccacttccttctctgccatccccccaaggcctggcgagtagtaggtggtcagtaaacacctgttccgtgagtgccgggtgtgcgttgacctcccagtcaccaacggcggaagcttcagccagcggacgcagggagttgtcccttgcaaagggggtgggtgctcccgggcgggaagggtggggccagagcccacggcgatgcctttgtcatgagctaggatggactgaatttgggctcacagccacggacaggagagaacagtgtgtccgccccgtcagtgccatccagcgtgcgtggctgttgtgcatcatttgtttgcttgagcaaaggctacagggtccagtgacattcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaacatagcgagactgcgtctctactttttttttttcctgagacggagtctcgctcctttgcacaggctggagtgcagtggttcgatctcggctcactgcaagctccgcctcccgggttcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgtctctctgagaaggagctatttgaggaaagtcctgaatgaggggagagaatgagccatgtagatagctgagggaacagtgttccaggcagaggcgcagcccgtgcaaaggccctgaggcaggaccatgcctggtgtgttggaggaacagcgaggaggcccccgtggctagagcagagtgaggaaggggagacaggaaggaggggagggcagggaggggactgatcgggccatgcagggccttgtgggccacgggaagaaggtgggcttttccccgcaaagaaggtgggagctatggagggctgcgggcagaggaggggtaatgttcatttaactcctggagtttgacaaaatgctatcatcaaaacagactttatcacagaacctctagctatccccgtcccctccgtaagctcctctgagcatagcaacagaacgggaaggtaaggcagcgattggaaacgcccgcgttatagatgagcggagagccgctggaggttggaggctccgacagaggaggtgactggtccagagccacatggccaggttgtgctggggctggaactccatcgaacgcaggtttcagggtgcagcccttgtttccataagataccccaaaatcagacaagcctgggacttgccacctcttctttaaaaaccccagtgctgtttttgttgttttttttgagatagggtctccctctgttgcccaggctggagtgcagtggctcaatcatagctcacccactgcagccttgacctcctgggctcaagcagtcctcctgcctcagcctcttgagtagctgatactacaggtgtgcatcaccacagccaggtaacttttttttttaaagtagagatggggtggggtatcctgtattgcccaggcttgtctcaaactcctgagctcaagtaatcctccctccttgaccttccaaagtgcaggaattataggtgtgagccaccatgcccagccctccagtgctttttttttttttttttgagacggagtcttgctctgttgcccaggctagagtgcagtggcacgatctcggttcactgcaacctctgtctcccgggttcaagcaattctccttcctcagcctaccgagtagctgggactacaggcacacaccaccatgcccggctaatttttgtatttttagtagagaccaggtttcaccgtgtcggtcaggctggtctcgaactcctgacctccagtgatctgccctccttggcctctggggattacaggtgtgagccaccactcccggccctccagtgcattttaaaggctctgaaaagtcctacgttgtcctgaaaactcctcagtgatgctgaacctttttgacctgtgaaccccaggtttgggtaaagtctgctcacatccggcggcacacccataggaaacccccagcccggctgtgaggagtgtgaactttgattcaccaggtccttggcccagctttagtttctcccgtgtccgtgtttgcttgtgcaatcatgaatatatattgaccagcaccaggtgccacattgaacagtttgtccgcgccgtcagtgccatccggcatgcacggctgttgtacatcatgtctttgcactggactgagctcagctgcagaaagcagcacatttcagagggtgtctaccgggccaggagaaaacacacaaaccgccaacattttaaagcctgtaatcgacatcgtatacaattggaaaagatgttcatttatatgttttgtttttgttttcttaagacagggtctcagtctgtcacccaggctggaatgcagtggtgcgatcatagctcactgcagcctggagctcctgggctcagacgatccacccacctcagcccccagagtagctgggactgcaggcacaggccaccacgctgggctaatttttagatttttgtagagatggggtcttgctctgttgcccaggctggagtgcagtggtgtgatcttagctcactgcagactcaaactcctggattcaagccatccccacctcagcctcccaagtagctgcgactacaggatgtgccaccatgcccagctaatttatttttatttttatttttgctagagagagtgtctccttatgttgaccaggctggtcttgaactcctgacctcaagcaatcctcctgccaaggcaatcctctcaaaatgcagggattacaggtgtgagccactgtgcccagcctgttcatacgttttaaagagaggtgcagacaaaactgggttggtgcatccacatccctctctgtgtgatgctgggtaatttgcttaccctctctgggtatcctggagattgtcagccccagccaaggatggttaaaaggcattaaacaatacctaggacagagcctgacatctggagctcattaaaccatccgtacatgcagatgtcgttataattattatcaatgctattctgtcactccacaccctgactcccacctcagtggccccaggtgggggtgctctgaaatttctctggcctggctgagcgggaggggccggggttctgctggaataaagaacagaggaggaagccttgaaggatttgttctgtcccagctgtccccagtatcacagttagccacacggatggcagaagggacctttgacagtggacacaggggctggaagggcccagcctggggctcactgcaatctccgccttccagattcaaatgatcctcctacctcagccttccgagtagctgggattacaggtgtgtgccaccacacccggctaatttttgtatttttagtagagatggggtttcaccgtgttagccaggctggtcttgaactcccgacctcaggtgatctactcacctcagcctcctaaagtgctggaattacaggcatgagtcaccgtgcctggccttggggctttatctgactggctagagaatgggattcaaacaccaggaatcatcccaaaccgccaatgagaaggagccctggagtgaggggaaccgagacccctcctaaaaggatttacagggtgtcacagaatcaaaattacagcaaaggctcaactgtgagatgccagggtggctgatcattgattctagacccatcactaccagctggtgttctgtgagtttgaagccattgctgtctagctttgtgcctcagtttccccagctggcgattaccgtcccccatatggggacggtaatcacgtgtctgctgcagaggagttacaaagatttgtgaggcaatggaggcaacatttgcagccgaacctagtcaaaggaattactcactgcgcattaatttgttgttttttgagatggagtctcgctctgtctcccaggctggagtacaatggcgcgatcttggctcactgcagccatcccccgggttcaagcaattctcccgtctcagcctccggagcagctgggattacaggcacgcaccaccacgccaggctagtttttgtatttttagtagagacagggtttcgctatgttggccaggctggtctcaaactccaggcctcaggtgatcctcccacctcagcctcccaacctccctagcatttcaacgacctgaagtgaccctcttgatttattttctgacttgttcatttcctgtcacgttcccattagaacatcagtgcctcgagaggagggattcttgtctgtctctgttgccgctgtgtcccttgggcgtctggcatccgggtggctctctgcaatctgtttgctgagtgatcaaaggaaagaactaatggcaacatagtgcagctccaatgtacagatgaagaaatccaggctcagagatgtggaagtacttgcccagggccacacagccggaagcccgccaactcttttagtaaagggccagtgacactgtaaacattttaggcttttaggcaggtcacatgcagtctctgttgcctattttttcttttgtttacgaccctttaaaaatggaaaagacaggccgggcgcggtggctcacgattgtaatcccagcactttgggagtccgaggcggacggatcacgaggtcaagagttcgagaccagcctgaccaacatggcaaaaccctgtctctactaaaaatacaaaaattagctgggcgtggtggcacgtgcctgtagtcccagctactctggaggctgaggcaggagaatcacttgaacccgggaggtggaggttgcagtgagccgagatcacgtcaccgcactccagtctgggagacggggcgagactgcatctaaaataaaataaaataaaataaaataaaataaaataaaataaaataaaataaaataaggaaaagaccatacttagctgactgtgcaagaataggcaaccccttctagtttgctcatctaatgtcagaacccacgaactgattccaaaaccctccacagagaatctaaaatgctgcaaaccccgactctgtgatgctggggatctaaagtgcttagtttgtttttttgtttttttgttttttgtttttttgtttttgtgttttttgagacagaggctcgctctgtggcccaggctggagtgcaatggcatgatctcggctcactgtaacctctgcctcctgggttcaagcgattctcctgcctcaacctcccaagtagctgggattacaggtgcctgccgccacacccggctaatttttgtatttttggtagagacggggtttctccatgttggccaggctggtctggaaatgctgatctcatgtgatccaaccgcctcaggctcccaaagtgctaggattacaggtgtgagccaccgtgccctgccaagtgcttggttctttagtctggagtgcagtggtacgatctcggctcactgcagcctccacctgccaggttcaaacaattctcctgcctcagcctcctgagtagctaggactatgggtgcatgccagcacacccagctaattttttttttttggtacttttagtagagatggggtttcaccatattgtccaggctggtcccaaacccctgacctcaagtaatcctcctgcctcggcctcccagagtgctaggattacaggtgtgagctctactgcgcccggccaagtgcttggttctttctcgactcaatcctattttgttctacacaggtcaggtctgcctccactcccccaaccccatgccccatttcacccattggcctctgaagcccagagatgggcaggggtttgtctgagaccacacagcaagaggggcagcagaggaggatgggaacccagatctgcttccctcccaggctacacccctgtagccccccaacccctgcaaacttgttatttaagcctcctcattacaggggtttggagccgaggaagccctgctgccttttcgtaaatgctctccctagacagcaatctttgatggaggctctgggagaagttgttcagtgatgtgcatttgtcgagcacctactgtatacctggtgccagtatagggttgggtggaagggtcttgtccactcaacacccctttttctgccctattattgccttccctggccaggcgaggtgactgacacctgtaatcccagcactttggatggctgaggcaggaggagcgcttcagccctggagtttgagttcagcctggccaacatagtgagacctcatctctacaaaaaaatgtttgttaaaaattagccagatgtagggccacaagcctgtagccccggctacttgggaaaagaaggcaagagaatcacttgagcccaggaggtcgagcctgcagtgagctatgatgacaccactgtcctccatcccgggccacagagtgaggccctgtctcaaaaaaaaaaaaaaaatcaagaccatgattgcccccccataaagagcccttttaaacattttttccctaatcactctcctgtgaaattttaatagcataggtatattttatatacctatatatattaaaaatgtacctgtgccatcaaatatatataatatatattatacataggtatataaagtataactatatgtcatatagataggtatataaaatgtacctatatggcctgtaggtatataaaatatgccatataggtatataaaatatacttacgccattaaatatatatttaatatacaaatatatttgtttttttctatactgtaacaacatatgtctgtacattattattattattattattatttttgagacagagtttcactcttgttgcccaggctagaatgcaatggcgtgatctcggctcactgcaacctccgcctcccgggttcaagaagcaattttcctgcgtcagcctcctgagtagctgggattacaggcatgtgccaccgtgcccggctaattttgtatttttagtagagacggggtttctccatgttggtcaggctgctctcgaactcctgacctcaggtgatccaccgcctcggcctcccaaagcactgggattacaggcgtgagccaccgtgcccatcctacatttttttaaaaacacaaaattctggccagacatggtggctcacgcctgtaatcccagtgctttttttttttttttgagatggagtctcgctccgtcgcccaggctggagtgcagtggcgcgatctcggctcactgcaagctccgcctgccgggttcacgccattctcctgcctcagcctccggagcagctgggactacaggcgcccgccaccaggcccagctaattttttttgtatttttagtagagatggggtttcaccatgttagccaggatggtctcgatctcctgacctcgtgatccgcccgccttggcctcccaaagtgctgggattacaggcgtgtgccaccacgcctggcctaatcccagtgcttttggaggcctaggcaggagggtcacttgagcccaggagttagagaccggcctgggcaatatagtgagacccccatctcaaagcagaacaacagcagaacttctgagctagacagacaactttgctttgaatctgacaccagctttgggaaatacgctgtgcgcactgggccttggttgaccaaccttacaaattgagcagatttaatcagatggggtcaggaagtgctaattcagcacagtaaaaactcagcagatggaagctgcccactggggtctggggaatcttggggctgtggaagttagccagccttcgacattatgcactttgtacacatctgctcagaccgaaagaaggtccattttaaggctgggtgtgtactaagtaggtggaggaggaggaattatctgtgcctctttttcttttctttttttttttttttttttgagatggagtctcgctctgtcgcccaggctggagtgcagtggcgcaatctcggctcactgcaacctctgcctcccgggttcacgccattctcctgcctcagcctcccgagtagctgggactacaggcgcccgtcaccacgcccggctaatttttttttttttttgtatttttttttagtagagatggggtttcaccatgttagccaggatggtctcgatctcctgacctcatgatccgcccgcctcggcctgtcagagtgctgggattacaggcgtgatccaccgtgcccggccacctctggaagcagccagggccacacagtgcactagaatattcctcgctgatggcagaatattctgtgctgtccaacttggtcaccaccagccacgtgtggctctttggtgcttgaaatgtgatttgttcaactgagcaacttaaaatttaattttcttttctttttttttttttttttgagacatagtctcgctctgtcacccaagctggagtgcggtgactccatcataactcactgcaacctccacctcccaggcttaagcagtcctcccacctcagctccccgagtagctggaactacaggcatgccactacacccagctaacttttgtattttttgtagagacggggtctcgccatggtgcccagtctggtctggaactcctgggctcaagtgatcctcctgccttggctttccaaagtaccgagattacaggcatgtgccaccacgccccgcctaattttatttcagcgtagctaacttaaatgtaaaaagtcatatgtggctgtgacccttgtactgatggctgtagaacgtgaggagttttcaggagccaaatgatggaagaatggtcagcaggtggttgagaactattcccaggttttagagatgatttaaaatgagacggctggccgggcgtggtggctcacacctgtaatcccagcactttgggaggccgaggcaggaggatcacttgacgtcaggaattcaagaccggcctggctaacatggcaaaatcctgtctctactaaaaatgcaaaaattagccaggtgtggtggcaggagcctgtagtcccagctactcaggaggctgaggcagaagatttggttgaaaccaagagacggaagttgcagtgagccgagattgtgccactgcactccagcctgggcaacacggcaagattccatctaaataaataaatacataaatacataagatgaggcagccaaataaaaaggaaggagattctgaccaggctactcacatgggtgaaccttaaggacattaagctcaattgagaaaagccggacacagaaggacaaatactgcaagtccactcctaggaggtccctagagtcgtcagattcatagagacagaaagtaggttggcggggtcagggggtgtcggaggctggggaggggacggggagtgagtgtttcatggggacagagtttcagtttgggaagagtagaaagttctggagaggatggtggcgatggctgcatggccattggaatgtatttaatgtccctaaagctgtgcatggaaagttggttcaaatggtaaatattatgcatattttaccacaataagaaattaaattaaaaattaaaatgagatggcatagatttatagcatattatttttaaaactaaactaattttggccaggcatggtggtgctcacccatggttccaattactcgacagtctgaggtggggggattgctggagcccaggaggtccaggctgcagtgagccatgattgtgccactgcactgcagcctgggtgacagagcaagaccctgtctcaaaaacaaaattaggccgagcacagtggctcacacctgtaatcccagcactttgggaggctgaggcacgcggatcacttgaggtcagaagtttgagaccagcctggccaacttggtgaaaccccatctctactaaaaatacaaaaattagctgggctaattaaaattagattagaaaattagattacaggtggcacacacctgtaatctcagctacttaggaggctcaggcaggagaatcacttgaacccgggaggcagaggctgcagtgagctgagatcgcaccattgcactccagcctgggcgacacagcgatactctgttccaaaaaaaaaaaaaaatttaatttaattaaaaaacacataaattcctaggactataggaaaagaagaaaacttccttaacccaagaaagggaactacaaaaccccacagctaaccccgtacttagtggtgagaggctggatgttttctcccgagatcaggaacaagacaaggacaccactttccccatttctattgaacattgtactggaagttctgccagaccaataaggcaagaaaagaggctggacgtggtagctcacacctgtaatcccagcactttgagagaccaaagagagtggatcgcttgagcccaggagttccagaccagctagggcagcatcgcgaaaacccgtatctacaaataatacaaaaattagccagatgtggtggcgtgtacctggggccccagctacttgggaagctcagataggaggatggcttgagctcaggagttcaagactgcagtgagccgtgattgtgccaccttactccagcctaggtgacagagcaagatcctgtctcaaaaacgaagaagagaaagagatcagcctggctatcatggtgaaaccctatctctactaaaaatacaacaaaaattagctgggcgtgtgggcgtggtggcacgtgcctgtaatcccagctacttgggaggctgggaattgcttgagcccgggaggcggagattgcaatgagctggatcgtgccaccgcactccagtcctggcaacaagagaacaagagcgagattccatctcaaaaaaataaataaataaataaataaataaataaaagatacaaaataacaccatcaaagacagtaccaatagcgatattaatcaaatagcaatagtagtgaagctgccctctgcctggtgaagcactcactatggcagccatggttctgggagttttattaataattcattcatcacctttttttttttgagatggagtcactctgtcgcccagactagagtgcaattggcccgatctgggctcactgcaaaatccgcctcccgagttcaagagattctcctgcctcagcctcccaagtagctgggattacaggtgcccaccaccacgcccagctaatttttgtatttttagtggagacggggtttcaccatgtggggcagaatggtcttgaactcctgaccttaggtgatccacccacgttggcctcccatagtgctgggaatacaggcgtgagccaccgcgcccagccaatgtttcattcattaccatcttgtccctcataaacagcttccaagagggggtgctatagttgtgtccatttcacagatgagaagagtgaggcgcggatgcatccgaggccccgctccctggctgcccgattcgcaagctcatgctgggagccaccgtggggcctgacacttagtaggtgcccaagaaacattctcccttcccagggaaacacccggatgccagctgggcactgcggcctgctgagacgccagctgggcactgcagcctgctgagtctgtgtgggctctggttccggaagagggtcctgtgcccacggcctggcgcccggacggccggctgcccaggctgggtccttcccaacgtcatggccaccggtgcccagccttgagacagtccaaagggaactggccagctccgaggggccgctggcagccccagcctgggatcggctgcagggcttggggccgagctgggcacactcccctcggctgctgtccagcccagatggccacggccggggcagcctagctggaggaagggcttctctcgtctgctcctctgtttcctgacgaggaaactgaggcaccgggccctgctcctgtgctgttcatggcatccttggtcttggcaatcagtgggtgctggacacacggtgtgtgcatagccattagcacggcgccaggctaactccagaggctccgtgcgctaggaaatatcattgctttgatcattctcacagcaaccctgagaatggtctccatttatttttttaaaacaaggtcttgctctgtcactcaggctggagtgcagtggcatgatcacagctcactgcacccttgacctcccaggctcaagtgatcctcctgagtagctgggactacaggtgcctgctaccatgcctggctaatttttttttcttttttgttgagatggagttttgctcttgttgcccaggctggagtgcaataatggcgcgatcttggctcaccgcaacctccgcctccggggttcgagcgattctcctgcctcagcctcccgagtagctgggattacaggcatgcaccaccatgcccggctaattttgtatttttggtagagatggggtttcaccatgttgatcaggctggtctcaaactcctgagctcaaagtgatctgcccgcctcggcctcccaaagtgctgggattacaggagtgagccactgcacctggactgtttttttgtattttttgtaaaaacggggtctcactatgttgccctggctggtctcgaactcctggcctcaagcgatcctcccgcttcggcctcccaaagtgctgagattacaggcgtgagccactgtgccactgcccctggcttaatcatcatctcattttgcggatgaagaaactcaggccttgaaaggaaagtgaggccgggcgcggtggctcacgcctgtaatcccagcactttgggaggccgaggcgggcggatcaccaggtcaggagatcgagaccatcctggctaacacggtgaaaccccgtctctattaaaaattcaaaaaattagccgggcgtggtggcgggtgcctgtagtcccagctactcaggagactgaggcaggagaatggcgtgaacccaggagacggagcttgcagtgagccgagatcatgccactgcactccagcctgggcgacagagcgagactctgtctcaaaaaaaaaaggaaagtgaccttctcaggagcacaaagacccggggggtcttggagacagtacttggctcaggtgtctgatcccagcacaaaactgtagataaaataaccctggtgaaaaagcccatcacagggcctgggagggagaacattgctcgtggttctgacccgcagctttccttgtttatgaaatggatacagccaggcatggtggctcacgcttggcatcccagcactttgggaggccgaggcgggcggatcacctgaggtcaggagttcgagaccagcctgaccaacatggtgaaactcccgtctctactaaaaatacaaaaattagccaggcgtgatgacgcgcgcctgtaatctcagctactctggaggctgaagcgggagaatcacttgaacccgagaggtggaggttacagcaagccgcgatcgcaccactgcattccagcctgggagacagagtgagaccctgtctcaaaaaaataaaaataaataaataaaatagaagaaagtaataatggggcggactctcgtgattgaggtctccaaatgccctcaagtgcttcaggagtatcctctcctcactgcctcccagctctgctaaggcctgggcagtgtttgtgcccacgtggaagatgagaaacaggctcaggacagttaggcgacttgcctgaggtcacacagcgatcgcgtcctggccttggggtctggcgggtgggcaggaggggcgtgattctcttcctgcggctttcgacgttggttgctgccaccttcgtctttgacctgggtgatccatgggtggggctggggaggggcgtctgcctggctgggcttgtccacctgccccccaacttcagccctccgtggaggggtcagggctccagagggggcggatgtgactcgtcctgcatccaggctgccagagccgataacgctgagctcagcgtctgtctgcctgcgcgtctgccaaggaacctaattatttttagataagatggaggggcgggcgccggggcagagggagcacccaagctgggcgggcagtggggtcgtcgccatcagagagaccacccctcagcctcctctctctggggtccctgaacggcaacccaggactaacagccgggtccctgggactacaggggcagaggctgaggctaagggacgtgacgtctccaggactcacctctctggtcctcagtttccccatctgtaaaacggacatagtgatagacctcctgcatagggctaaggcggggctgaatgactgaacctcattttattttatttattttgttttatttattttattttatttattttgagacggagccttgctcttgtcgcccagactggagtgcagaggcatgatctccacttgctgcaacctctgcctcccgggttcaagcgattctcctgactcagcctcctgagtagctgggattccaggagcgtgccaccatgcccggctaatttttatatttttagtagagacggggttttgccatgttagccaggctggtcttcaactcctgacctcaagtgattttcctgccttggcctcccaaagtgctgggattacaggtgtgagccaccgtgcctggccgttttgttttatttttttgttgttgcttaatttcattttctgagatggggacttgctatgttgctcaggctggcctccaactccagtcgcccagactggactgcagtggtgcaatcctggctcactgcaacctccgcctccgaggctaaagcgattctcctgtctcagtctcccaagtagctgggattacaggtacgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattccaggtgtctaagttcttacccacgactgagccgcccctgcagaagcggagggcttacccaacatacgggtacactggcgctcacagggcctagctggtgtctgcagggtgcctggccagatgtctgtgaccctctagggcagcagccaagggaagggcccaaagagagaccccagggcctgggtgtgttttggggccactgtttgtctccatagcactggcccagcccaggactggggccaccagcatcgacacttcatctgctcctggggtggggtctctgtgatgccaccagtgtttcttccctctctttgcagatgcagagcaaagcggcagtccccggacagggatgggctctgaccaggaggacagcaagcccatcacgctgggtgagtctgggggcagcgtggcggtgaagggcggagggcgcagccctgtcctcgtcttttatttgggaatcatttgcttggcaccactcgttttacagatgagcagactgaggctcggagaggttaaggggcctgtccaggggctaccagggagctgggttggaacccacgactctgagctcccagcttctgggctctgaggtgctcaccccatgggagaccccagagggttctacggtcccatgggacgtttgagggtttttgtttgttttgttttgttttcattcatttatttattttgagatggagtctcgctctgtcatccaggctggagtgcagtggcacaatctcagctcactgcaagctccgcttcccgggttcaagtgattctcctgcctcagtctcccaagtagctgggattacaggtacctgccaccacacccggctaatttttgtatttttagtagagacggggtttcaccatgttggccaggtcggtcttgaactcctgacctcaggtgatccgcctacctcggcctcccaaagtgctgggattacaggcatgagccaccgtgcccggcctgtttgtttgtcttagaaacggtctcacgctgctgcccaggctggagtgcagtgacaccatcctagctcactgcagcctggaccagctaggctcaagcgatcctcctgccttagcctctcaagtagctgggactacaggtgtgcaccaccatgcctggcttttttttttttttttttttttttttttttttttgagatggagtatcactctgtcgcccaggctagagtgcagtggcgcgatctcggctcactgcatcctccatctcctgggttcaagcaactctcctgcctcagcctcctgagtagctgggattacaggtgtgtgccaccacggctggctaatttttgtatttttagtagagatggggtttcaccatgttggccaggctggtctcaaactcctgacctcgtgatccacccacctcggcctcccgaagtactgggattacaggcatgagccaccgcgcctggcttttttttttaattttttaaatatttttgtagagacagagtctcactatgttgctcagactggtctcaaactcctgagctcaagtgatcctcctgtcttggcttcccaaagcgctgggatcataggtgtgagccaccacacccagccctcatggggcgtctaatagatgggtaggacagtgtaattctatgttgtagggataggaagtgggaaaattaacctcacttagaccagagcagtcacttccatcctagcccccagctcctgcccttggcccccaccatttgtccttctcactatggccagaggacacctgtgagcccccaagtcagggcccgtccctcctctgcgcacagccatccacggctcccacctctcttggggtaaaagcccaggtcctccctgtggcccacaaggccctgcacaacctgtcccatccctgccctgtcctcccctcctccctctctccccgtcgtccactcccagccacacagacctcctcgccgttcctccagtgcaccagacccagtcctgcctcagggccgctgcacattctgttacctctgtctaaacagccaactaactgctcgcttgttctctccagatctcccctggtctcagctcaaatgcccccttctcagagaggtctaccctaaaccccttcagcataagcagcctctggctaccctcaatctttttttttttttttttttgagacagagtcaggctctgtcgcccaggctagagtgcaatggcgcaatctcggctcactgccatccccgcctcctaggttcacgccattctcctgcctcagcctcccgagtagctgggactacaggcgcccaccaccacacccgggtaattttttgtacttttagtagagatggggtttcaccgtggtagccaggatggtctcgatctcctgaccctgtgatgcacccgcctcggcctcccaaagtgctgggattacaggcatgagccaccgcgcccagcctggctaccctcagtctcagccctctgttttctttccttcagaggaagttagtgattgcctatggatttgcttagttgtttagtgactgcacgggtgtctgctcatctccccagtggaatgtcacctcctccagggcagaggctttgtctgtctacatctctgttgtgccctcagggcttagaatggggcctgatgcagagtgggtgctcaataaatacttgtagaaagaaaagaaggagagagggagggatgaagcagagagaagaagacaagagaggatatatggggagaggaaggaggagagatgaaaaagaaggaaggggccaagtgcggtggctcacgcctgtaatcccagcactttgggaggccaaggcaggtggatcacctgaggtcaggagttcgagaccagcctgaccaacatggtgaaaccgtctctactaaaaatacaaaaattagtcgggcatgttggcacacacctataatcccagctagtcgggaggctgaggcaggagaatcgcttgaacccaggaggcagaggttgtggtgagccgagattgtgcaccctgggcgacacagcgagactctgtcaaaaaaaaaaaaaaaaaagaagaagaagaaagaaggaaagaaagaaagaaaagaaagagagagagaaaaagaagggccgggtgcgggggcttacgcctgtaatcccagcactttgggggactgaggtgggtggatcacctgaggtcaggagtttgagactagcctgatcaacatggagaaaccctgtctctactgaatatacaaaaattagccaggcgtggaggcacatgcctgtaatcccagctacccgagaggctgaggcaggagaattgcttgaacccgggagacagaggttgcagtgagctgagatcgcgccattgcactctagcctgggcaacaagagtaaaaactccgtctcaaaaaaaaaaaaaagaaaagaaaagaaaaagaaggaaggggccagggcgcagtggcttacacctgtaatcccagtactttgggaggccgagtcaggtggatgacctgaggtcaggagttcaagaccagcctggccaacatggcgaaaccccatctgtactaggaggacacgggaggctgacgcaggagaattgcttgaacccaggaggaggcggaggttgcagtgagccgagatcacgccactgcactccagcctgggggatagagtgagactgtctcaaaaaaaaaaaaggaaaggaaaagaaggaaggaagagaaagcgagtgggtgaggcgtccttcttggaaggaccggaacaggcatgcacagggaggctggaaggttctcggaggttcacaggcctgaggccactcctcactggcccccggtgactcctccgtctgtgacccgggtcctccgcggcctcctgtgatccccagacgcctctctccaagccagatgttggagggaggtgggggcagcggcgcttggcctggtcccctggggagcttgggcgtctggtagaggaaatcacgtcctcccagctcgccagggagtcccccagagatggagctgagcaggcgctgcacaaacaggaaaccccggtcgggggaggcggagggggcgtgctgacaccagctggccagctgggtcagcaggaaacggctctggccacttctcctggacactcgggggccaccgctctgtcctcttcagaatgcgtggccctgaacctcccagcgcggggcagggttggttcattgccttcactcagcaaatgactgtaacagggggccgggtgcggtggctcacgcctgcaatcccagcactttgggaggctgaagcgggaggatcgcttgagcccaggagttcaagaccagcctgggtaatatagcaagaccctatctctacccaaaaaaaaaatatacacacacacacacacacacacacacacacacacacactagccccaggagttcaagaccagcctgggtaatatagcaagaccctatctctaccccaaaaaaaaaaaaaaaaatatatacacacacacacacacacacacacacacacacacacacacactagccaaacacggaggtgcatgcctgtaatcccagctacttgggaggctgaggtgggaggatcgcctgagcccaggagtttgagaccagcctgggtaacatagcaagaccctatctctacaaaaagtaataataataatacaaaaattagccaagggtggtgatgcgtgcctgtagtcccagctacttgggaggctgaggcaggagcatcacttcagcccaggagttcgaggctgcagtgagctatgattgcaccgctgcactcgagcctgggcaacagagcaaaattctgtctctaaaaaagaaagattgtaacagggggactggcgggggtttgggtctgcagaactggacacagccctgagctccctgcagtccgtgctgccccctgggggccgggagaggaactgctcccaccgccacccaaaagccaagagcctgtcccacctccaaacctaccaggctccctggctctttccactccaaccctgctggcctgcaacttgccaagtgcatttctacccggaggcctttgcacgggctgttcccagtgccgggaacatcgtggccctcagggaggtgatgaaacatcatccccatcggagaagccaacagtcacggggcggttgccaggcgctgttctcggagctttgcagattttaacaagttccttcctcttatccagtctcatcttgaggtctgtaaaatgccaccatctcggtcaggctttctctgagccctgggtgtaaaatagcctccctccccaccctagctagttccccaccagccgcctgccttaccacaggctgatgcacctcgcatttgacttaatgagcttttaatttgtagtaaaatgtgcatgatgtacaatgcatcattttagccatttttaagtgtccaagtcaaagtgcactaagtacattcacctctatctaattccagaacctttctttttttttttttttacccccaggctggagtgcagtggcgcaatctcggctcactgcaacctccaccttcctggttcaagcaattctcatggctcagcctcccaagtagctgggatcataggcacatgccaccacacccggctaattttttgtattttcagtagagatggagtttcaccatgttggccaggctggtctcgaactcttgaccttaagtgattctcttgcctcagccttccaaagtgctgggattacagatgtgagccgccgagcctggcctaattccagaacatttcatcccccctaaaagaaaccccatccccatcagccaccactccctgtctcctctcccagccctggtgcccacgcatccccttcttgtctctgtggcttggcctgtcctggacatttcagtgaaatggctcatgcctgtaatcccagcactttgggaggccaaggtgggtggatcatgtggtcaggagttcgagaccagccggaccaagatggtgaaaccccgtctctattaaaaatccaaaatttagacaggcactgtggcaggtacttgtaatcccagctacttgggaggctgagacaggagaatcgcttgaacctgggaggcataggttgcagtgagccaagattgcgccactgcactccagcctgggcgacagagtgagactccgtctcaaaaaaaaaaaaaaagaaaagaaaaagaaagaaagaaatggcatcacacactgtgtggccttttgtctctggtgtccctcactgaatgatgtcctcaaggtgcatccatgttgtagcctgtgtcagagcctcgttcttttatttttatttatttactggttttgagatgaagtctcactctgatgcccaggctggagtgcaatgtcgcgatctcggcctgtagctgggactacaggtgcccgccaccatgcccggctaatttttgtatttttagtagagatggggtttcaccatgttggccaggctggtcttgaacccctgagctcaggtgatccacctgcctcagcctcccaaagtgctgggattacaggtgtgagctaccactactgcgcccagcccaaggcctcattctttttcttttccttcttcttttttttttttttttttttttttttgagacagggtcttgctctgtccccgaggctggagtgcagtggtgcaatcatagctcactgcagcctcaacctccagggctcgagctatcctcccgcctcggcctcccaagtagctgggactacaggtgtgcaccaccacgcccagctaatttttgtactttttgtagggatggggtttcgccatgttgcccagtcccgtctcaaactctggggctcaagtgatccacctgcctcagcttcccaaagtgctgggactataggcacaagccaccatacccagctaattttcgtattttttgtagacacagggtttcgccatgttgcccgggctgatctcaaactcctgagctcacgagatccacccacctcagcttcccaaagtgccgggattacaggcatgagccaccacgcccggcatccttttcacggctgagtcctattccagtgtgtggctagaccacgctgtgtttatctcttcatcttttgaagggacatttgggtggctttccagtttgagctgtggtgaacagtgctgctaggaacattcgtggacttttgctgacctattaatcttggctgctgtctgtcgctcacactggactttgagtctcacaggggcaactgcttcagcctgtatcatctcctgctgtgccggggcccagctcagaatcagacactgtggatgcttagtaaacgcctgttgagtccatgaatccctcctacaagggcgtccgagggcaggacagggctgtccccaagctgtctgaggttggccaaggctcccgacctctcggggacaacttcgatttccaaatctgtgaaatgggtccaaaccactccagtcgagaggacagtctcccttcctttaatattaggtaggagcaatgctggggacactgagggttttaactgcggcttgtgggcctcccattcaaccccccattttaactgacccattgctgggtgccaagctctggtctaggcacgaaggacactgcagggtcggggcagacagacatccctgcccacacggacctcccagtctgaaggggagaagaacaagaagccagagtatctcgaagggtgacagtgtgtaaagcaagccagctgcccctcccaggcagttggatacagatctcacgacaaccccgatgatgggattgatggtttcacttttgcaattagggaaacttggaggctgagagagggaaagtgacctgccccagatcacacaccgaggcaggtgatggagccgatgtgagcccaggcctccgctttccgctcttttttttttttttttttgagatggagtcttgctctgttgcccaggctggatggagtgcagtggcgcaatctcggctcactgcaagctccacctctcgggttcacaccattctcctgcctcagcctcccaggtagctgggactacaggcgcctgccaccacgcccggctaatttttgtatttttaggagacagggtttcactgtgttagccaggatggtctccatctcctgacctgtgatcctcccgcctcggcctcccaaagtgctgggattacagacgtgagccaccgcacccggctccactcgttttttaagagagggtgtcgccctgtttcccaggctggagtgcagtggcacaacaatggttcattgcggcctccacctcccaggctcaagtgatcctccagcctcagcctcctgagtagctgggactacaggcacggaccacaacacctggctaattttaacactttttgtagagatggggtctcgctgtgttccccaggctggtcttgaagtcctgagctcaagcgttcctcctgcctcggcctcccacagtgctgggattacaggcatgagccactgcgcccggcctgctgttcacttgaatgcagcattccacagcatgggggaacccggatgaaggctgtgtgaaggcccacactggacaaggaccccccacggggccttccccatcagactggagctgtcattcccccacagcacaggatggacagggggaacgtccaggctcgggccagcccccaggagtccaggcagccctggagtgtggggaagggaaacaggcccagctcagcctactgaccccgctgtcttcctgttccagacacgaccgacttccaggagagctttgtcacctccggcgtgttcagcgtcactgagctcatccaagtgtcccggagtgagtgttcccgtcagccctgagctgggtcttggagaggggagggggccgcagggaggaaggagcccacccccctcaccctactccttgtcctttccagacaaccccctgtgtcactaagccaaggttcctagaaagggaggtggccaggcccttcccagagcccaaggtcagggctccctcccacctctccaggaaacagaatctaaatgctggatggcaactaaggaaacttctgccccagcatccctcctcctccctggggcctccactgtcctgtcccaggagaccccaaaggaccccgcccctcctgtccccttgctttctctgctgacctgctggggacccagcacattccgtcacacactgtctgaatcccaccccagcgagtcctgggcgctgtccttctttagccctgactgacaccttccctgtccagatcagcagagcctggcctccagctttggctacacctctgcctcacagtgtgctcttggcctctccccatggccttggtcctctgatccatagaataaaactggtttcagccaccctaggaaccgggccaatatgggaagggggtccccctttggactgcacccagtggctttccctacctctctaaagcaaaccgcagcactgggcactgcttcctgcctcactctcctctgtcaccctctgcagcacccgtggtgactggaacaggacccaacttctccctgggggagctgcaggggcacctggcatacgacctgaacccagccagcactggcctcagaagaacgctgcccagcacctcctccagtgggtaagtacccaggtccccacctctgggcatttcatgaccccattcatcaacccatcccctctggcccgagctgactcattcctctccctggaatacctcttttcacgattcacctggcctgagaaactcctactcatctcatccttcaaaacccagccagccccacgtgcctcttcccctagccctgacagcccaccgtgggctcccccagcctcaagtcctgccggctcagccagcccttaggaccctccccacccagaagaatgcagacacaggttgttgctgagatatgctttgtgacctcgagcaggtcacactgtgtgtgccccagtttccccatccataaaatgggatcatacccctaacaggcagttctgaggactacaggtggccaggagattagccaggctgcctgggttttggtctccaccatgctagcttggtgtccgacctgtgttgagaccctccctgcctctggcccgggtgtcccatccaagcaatggacaggttggaacaggcgttcgtagggaacgggctgaacgcccgcggctcccgcgatgtctcgcgatactacctccctcgcccccgctcacttaaggaccggaagtagcaaagcccgccgtcgcgccccccgccccgcgtctccctggtaaccagcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggtagggctggtggcgggggcggagccggccttccggtctgagtcaccgtggcgggaactacgtcttccggcagccactgcgcgggcgccgcggggcaggaagccggcctggagccgcggggcctcctgggaattgtagtcgtcccgagctgcgcttggctggaagtacggtccgggttcgcgttctcggatctctttggttccgctgcggcgaaggagggcagagactgtcccctgcctgactctcctgccctccggccgtgaatgccacatctctgtggggtccccgagctgcaggatggactcagtagtgactctgatcaacagggcgcctcttcctgggatctgtcatagaatccctcgtctgtagggaccctgtttgtcctcttcccctctagaaggtcctgagatgccggatcccttctcattggggtccttcttgaggttacttttttttttaaccaggttcccatctccatgggatcttctggttctgcaggagactcgtctcctttctgtagggtctccattcccatggcgtcgttttctaggaagattttatcctcttgcttttctgtcttcagaagggtcctctctggggtgtctttctttctttctttctttctttcttttttttgagatggagtttcgctcttgttgcccaggctggagtgcaatggcgcgatctccgctcactgcagcctccacctccctggttcaagcaattgtcctacctcagcctcccaagtaactgggattacaggcatgcaccaccatgcccggctaattttttctatttttagtacagacggggtttcaccatgttggtcaggctggtctcaaactcccgacctcaggtgattcgcccgcctcggcctcccaaagttctgggattacaggcgtgagccaccacgcccggcctctgtttttgtttgtttgtttgtttgtttgtttttgaaacggagtctcggtctgctgcccaggctggagtgccggggtgcaatcttggctcactgcagcctcgacctcccaggttcaagtgatcctcctgcctcagcctcccaagtatcggactgcaggtgcatactgccatgcgccgttaattttttttttttttttttttttttttttggtagagatggggtctcactatgttgcctaagctggtcttgaactcctgagttcaagtgtgatctttcctcctgcctcgtcctcccaaagtgctgggattccaggtgtgagccaccatgccgggcccctcttatttttttttaatttttgttttttgagatggagtcttgctctgtcacccaggctggagtgcagtggcgagatcttggctcactgcaacccttcctcctgagttcaagcaattctcctgcctcagcctcccaagtagctgggattacaggcacccaccaccacacccggctaatctttatatttttagtagagacagtgtttcaccatgttggccagtctggtctcaaactcctgacctcaggtgatccacccacctcggcctcccaaagtgctgggatgacaggtgtgagccactgctcccggccacctgtaggatttttagaagcagtataacattaggattaagaggtcagattcaggcattggagagacctgggttcagatcccagccctgcccgtgtctagctctgtgtgctgtgtaacctggggcacatcacttaacttctctaagcctcagtttcttcatctccacaatgggggtgatgtgaataatgttctttgggagctacaggaggaggaagggtaggatgtgcgtgaagcaaccgtctggcccatgcgacatacccgggaaacgggaggtcactgtcatccacgtctttataacattcctgtctctgaccaggctcggtggctcacgcctgtaatcccagcactttgggaggccgaggcaggcggatcacgaggtcaggagatcgagaccatcccggctaacacagtgaaaccccgtctctactaaaaatacaaaaaaaatagccgggcgtggcggcgggtgcctgtagtcccagctactcaggaggctgaggcaggagaatggcatgaacccgggaggcggagcttgcagtgagctgagatggcgccactgcactccagcctgggtgacagagcgagactccgtctcaaaaaaaaaaaaaaattcctgtctctttccggcactcggacgcatctagttgtgacatttcaggtgccaaggcccctcccttccacagtgtgggctcccagagcaggaacattcctaaagggtctccatccctcaggggacctgtctcagtatttatgaggttctttttttgtttgtttgttgtttttgttttgagatggagtcttgcttgttttgagagatcacgccagtgcacgccagcctgggcaacagaacgagactatgtctcaaaaaaaaaaaaagaaaaaaaaagtcacttctgtttcgttttttttgttttttgttttttgttttttttttgagacggagtttcgctcttatcacccaggctggagtgcagtggtgcaatctcggctccacctcctgggttcaagtgattctcctgcctcagcctcccgagtagctgggactacaggcgggcaccaccacaaccagctaatttttgtatttttagtagagacggtttttactatgttggccaggctggtcttgaactcctgacctcaagtgatccgccaacctcaagtgatccgcccatctcagcctcccaaagtgctggcattacaggtgtgagccaccgcacccagccgtgacttctcattaactctgtaattgatgaggctgtcagaatgtaaactgcacgctaattaaagtgaaagaccacctttgcgatgagccaaagcaaccctgagaggaaaaattgtagctttaagtctatttattaggagaggagaaaggtggaaaataaagaatctagctttcaacagagaaaactcaaaaagaaaacattttaagctctggagctcagtctgacttttctgcccggctgctcactggcaaccccttccactggggaaggaggtggtagcaatggggggaggacaaagaggaagcccccaccagcttctgctctgtgattgggaatcgcagagctagcagggaatgtcagaggaggtctgtgctcctgcagcttccacttgattacctcaggggatggcaaactcactccctcctgagggtttcttttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcacccactaccacgcccggctaattttttctattttcagtagagacggggtttcaccgtgttagccaggatggtctcgatctcctgacctcgtgatccgcccatctcggcctcccaaagtgctgggattacaggcgtgagccaccgcacccggcctcctcctgagggtttcatcctcagtgtaaagccctcctgtgtgctggccctacctgaggccctggggacacagagatgatccaacccactcttgtccctaccttccaggggctaacagcctagtgagggagatgggtttttatccaggtgactacagcccagaggaggaggcacagaagacagtcagggggaacaagaggaccctgatagaacttggaagaaaagggaggacctccccgaggaggagaatcaggctgacagagcagtgaggagctcgggcaactggcttctctgcttctccagctgtgtgacatttggcaggttccttaacctctctgcccctcaatttcctctgctatacgatcaggttgctggccgggtgcagtggcttacaactgtaatcctagcaatatggcaagaccccatctctacttaaaaaaaaaaaaaaaatagcatcacatagtggtgtacacctgtagtcccagctccttgggaggctgaggtgagaggattgcttaagacgggaggtcaaagctgccctgagctatgatcataccactgcactccatccggggcaacagagaaagaccctgtctcaaaaaaaaaaaaaaaaaaaaaaaaaaaaaaaaaaaaaaaaaaggctcacctgtaatcccagcactttgggaggccgaggcaggcggatcacctgaggtcaggagttcgagaccagcctggccaacagggtgaaaccccatcattactaaaaacacaaaattagccgggtgtggtggtgggcacctgtaatcccagctactcgggaggctgaggcaggagaatcacttgaacctgggaggcggagggtgcagtgagccgagattgtgccattacactccagcctgggcaacaagagcgaaactccatctcaaaaaactctgccttgatatcccagtgaagagaaaacactggaagaatttttttttttttttttttgtcagagtcttgctctgtcgcccaggctggagtgcagtggtgtgatctcggctcactgcaagctccgcctcccgggttcatgccattctcctgcctcagcctcccgaatagctgggactacaggcacccaccaccatgcccggctaattttttgtatttttagtagagacggggtttcaccgtgttagccaggatggtctcgatctcctgacttcgtgatctgcccgcctcggcctcccaaagtgctgggattacaggcgtgagccaccgcgcccggccaaacactggaagaattttaacacccgtggcccagggctggactttacgtaaagcacgcacctggggcgtgagagccgggtttattattaattcgcggctaagctacaaccgggatgatttaagtggatttatccgcagggaagatgatgggagggcattcccagcagggagaatcgtggtttgaggagttgcactgtggatgtttggggccagaccatcctctggggcggggctgtcttgggcactgttgggtgctgtgcagagttcatggcctccacccactccgtgtcaggagcaccccccagtggtgacaaccgtaaatgtccccagacctggccaaatgtctcttgcgggcagaatctcccctataatatagccagaggcatatgcaaagcacctaaacggagtggggagaaggtgcgtgacccctggtctgggccactcttttttttttttttgagacggaatctctctctgtcgctcgcccaggctggggtgcaatgcgcgatcttgactcactgcaagctctgcctcccaggttcaagcgattctcgtgcctcagcctcccgaatagctaggattacaggtgcccgccaccacggctggctaatttttgtatttttagcggaggcgggttttcaccatgttggccagtctggtctggaactcctgacctcaggagttccaccacacccggctaattttgtgtttttagtaatgatggggtttcaccctgttggccaggctgctctcgaactcctgacctcaggtgatccgcccgcctcggcctcccaaagtgctgggattacaggcgtgagccactgcgcctggccttttttgttttgttttgttttgtttttcccaaatagtgacttgctctgtcgcccaggatggagtgcagtggtgcgatcagcgcccactgggctcatgccatcctccttcctcagcctcccaagtagctgggactatgggcacttgccaacacacctggctattttttgtactttttgtagagacagagttccctgtgttgcccaggctggtcttaaactcctgggctcatcctcctgcctctgcttcccacagtgttgggatggcaggtgtgagccaccacacccggctggccgctttttctctatgtcccttcccaacattttagtcccagacagccctgcggaggtgcctggcaggcacctcattttgcagagggaaaccctgaggctcaaagaggtgacatcacctgctccaggtcaccccagcggcaagcgggtgcacagggacacggaaccacgtggccgttcccagcggccccactcagggtacctcgctctctttgttttatggggcatctgtgatgtcctaagccgggttatttcccctcccggcaacactctgtgagatcagggctgcccctggccatcagttgacaagtggggaaactgaggcccaaaggtcccacagcaaagaaggggcagagccccgagcttatgcccagtgcttcctgggcctctccccatcgctgtggcctgcatcggtaaacatttcgcagcctctgaagtcccaagggggacgcctcagaacaggcctggcccctgggctggagcagggttcctgaggttcccagtggggcccagctgtaacctcattggtggaccgaggcaagggccagaggggcccaagggaagggccagaggggccgggggcacaggaagggccggaggggctgggggcacggggagggccaggcttattgttgcagcctgcaaggctgtcccaagccgggtgcctccgcagagggaggacacaaaacaggaacccaggcaggcagggtctctcccgaaggtgcccttggcccctggccaccaccctgggatgctcctcctcctcctcggcatcctccccccacccttccctgccctttccagcttcctgtctagacagcccccaattagccactcattaagggggttaagctgattagagcagctctcccttcctctggcggactcggggccttttctcccgggcagtgctcagccagtccccaaccctgaggctcacagaggcctggggggatcatgccagcccgatgccaggcaagacccccaccccacacctccaggccccacattccagcctctaggctttgcccgcttggggcctgggccaggccctttctcctggccgcctccacccgaggcctccctgcttacgcggctgcgtggggtggagggaaggtgccttggagcagcccccactgtgctttgtttttgctgcttgtgtagctcccccttgaaggcgacaaaggtcccgtccacaggcggttattacacagggcggggcaggcagcccccatccattcctctcctctgtcaccccaggcttcccatcccttttttttttttttttttgagtcagaatctcactctgttgcccaggctggagtgcagtggcatgatctcggctcactgcagcctctgccttccagattcaagcaattcttctgcttcagcctcgcaaatagctgggactgggactacaggcgcctgccaccatgaccagctaatttgtgtatttttagtagagatggagtttcaccatgttggccaggctggtctcaaactcctgacctcaagtgatccgcccgcctcggcctcccacagtgctaggatgacaggtgtgagccaccgagcccagcccgcccatccctttttttaaccccagggtggaggctagtgcaacgtggcctggggagggacagagttgggttccaactccacctccacccccccttggctctatggccttaggcgagtgacgtcccccatcaggcctcagcctccacatctgtgaaatgggcgcagctcctgtaagctctgcacggggcagctgtgaggaccacattaagagaggaggctagtgccttcacagaaggtcctcacccagggcgatgctgccccacccccagggacactggccggtgtctagggacatctgtggttgtcacaactgggagagctcttgacatggagtgggtcgaggccagggatgctgcttagcaccctgcagtgcccaggacagcccctccccagggaacgagccagccccaatgtctacagtgctgaggctgagaaacctgtattaattatgtagaaaaaaattgaggctgagtgtggtggctcacacctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccagtgcactccagtctgggcaacagcgtgagaccctatctcaaaaaaaaaaaaagaaaaagaaaaaagtctgccccctgctcacaacggaataaactcctagtgtggcagacggtgtgtaaaccagggggacccccagctcctgggactcacctcctctctccctccccactcaaggtgtggatttcaatgtgtgcagcctcctgggacctctgcagggcagaggatcatgggacgcagaggatcatgggacgcagagtctcttgggggtccatggaatcctctaagacagaggattttacctatgggtgatcctgaccccagaggacactgggtgacatctggggacctgtgtggttgtcacgactgcagggtggtcctggcatggattgggtccagggacaccgcttagcaccctgcagtgctcaggatggccccaccctagagaatgatccggtcccaaatgtccacagggcccagaggagaccttggtgcactgtcaacgccccgtggtcactgctgtcctcatcagattcatgccctgcatcggggcctctgtccactccacacactctgtgtagggcccctcctgaccccggaccctagagacccagccagagtgggccttggccccctgggggagccggcatttcagtgggagatgggcttgtttgttgagcaaacaaatggctgctccgacggggtgatgagggccttttgtcaaatacaaagaggaggtcagatgggcgtgtgtgacaaatggctgctccgacggggtgatgagggccttttgtcaaatagaggaggtcagatgggcgtgtgtgacaaatggctgctccgtcggggtgatgagggccttttgtcaaatacagagaggaggtcagatgggcgtgtgtgttaaacagacaggaagaagctctgatgggggagccctcgggcctgcgtcctcctcacagtcaatattctcagatggggcattcaggatgccgggagtggcgtatggatgtgttccctgagaggaaagatggccactgagatgggcgggggacgcacatgcccgctggctgaacagggaggtcccacaggggtcccaggcatgcctgctgaacagacagaggatgcttggaggcggggtgcagagtcagtgtccgtagagcctgccgggagcgtgccggcttattctttctcgcggtgcctgagctgcgctcccccctccttcctgccctgccctggctgccgctggccccatctcaggaagctctagcggtgcctgcagggatgtggcggccgggggtggagtctgagccagactatttccatccaggacaagcggttctaggaaatcctcctaaatgagcgtctgacaaccctaacctcgttcccgccgtggccctgcgcttgcagggagctgccagcccctgcacacacacacacacgcttgcacacacgcatgcatgctcatacatatatgcacgcacgtgcacaggcgtgcacacatgtatgcatgcatgcttgcagacctgtacgtgtgcgtgcaagcacacatacatagacatgaacatgcatgtgcaggcatacacatacatgcatatattcacgtgcacacgcatgtgcgcattcacacacatagacacgtgcacaggcatacacatacacagatatgaacgtgcatgtacaggcatacatatgcaggcgtgcacacgtccacatatgctcacatgcgtacacacacatgcacagacatgcacacatgcatgcagctgtgcacatgcgtgcaggcatacacacatacatgcacgcacacacatgcatgtattcacatgcacacacacacgtgcacaggcatacacatgcacacacacgtgccgacaagaccagcctggcctccccggctccaggccaccctcattcctgccacatcctcctgccctggaaaagcccgggcctggctgctggggcccagcttggtcacagacttcatggcatcccactgggcagtggggcctctctgggtggctcagcctcgatgtccgaggcctcaggagtgttcccccttgagtgttcacaggctgggcatgagtggaggtgtcatccttcctgccccccatgtgggtgtcctgggtgcccgcctcctccagagccgggtgttcccgggtccctgggaactgctgacctgcttctggggtgtgtcccagtgacaccttcactcctcacagcatggtgtgtgcagggccatggggacagctggttccataaccacaaaagcagatgaagagctgcatgtccccccacagctgggtcctggatctgggctccccctgggctgcagccatcagagaggacggaagttccctgagtggtaaccccgttcagggaaggatgcagcgatgctgggaggatggaggaggtggggacaggactggggagggcctgtaccacacagatgcctgcaggtgcctatggaaccaccagcaggagacccaagacacggtgacatcctcaccgtttctcatcagggcatcacccggggacagcaggtcacatctggggacatccgtggttgtccccactgaggggcgctcttggcacggagtgggtggaggccaggggtgctgctcagcgccctgcagtgcccaggacagctccctacagagaccgatctggcccccacatcagcagtgctgagactgagaaatcctgcgtgaattatttggaaaatattgagttacgtcactgctcacaccagacaccagaagaagctcctgacagggcagacggtagaaaccagggggaccccagctcctgggattcacctcctctctccctcctcactccgtgtggatttcagtgtgtgcagcctcctgggaccacagcagggcagaggatcatgggacatagtctcgtggagggtccatgggatcccctaacccagagggtctcacccacacgtgattcttgcccagggtacttttggtgatgtctggggacatctgtggttgttacaaccgggggtgctcctggcatgaagtgggtggtggccagggactctgctcagcaccctgcagtgcccaggagggccccaccccagagaatgatccagccccagtgtccacagtgcctgtctgagagaccctggaggtaaggaactccaagggccaggtcgaagggaagctaaactcatcaccctgtttggatggtctcagtagatatgttttaccttaaaagaaatgtaaaaatcctttctaaaaattcggctccccagggcacgcctccctgagattccatttccagggatagggtagggcccaggacactgcatttctcaggcaagatgtgatccttagccctcacttgaaaaagcttctctggggccaggcactgtggctcacgcctgtaatcccagcactttgagagaccaaggcaagaggatcccttgagcccaggagtttgagaccagcctgggcaacatagcaagaccccatctctaaaaaaaaaattgcctggacatgatggtgcatgcctgtggtcccacctacctgggaggctgaggtgggaggatcacttaagcccaggaggttgaggctgcagtgagccatgatcgtgcctctgcactctagcctgggtgacaaataactcggctgggtgcagtggctcacgcctataatcccagcactttgggaggccgaggtgggtggatcacctgaggccaggagtttgagaccagcctggccaacatggtgaaaccccatctctactaaaaatacaaaaatgacccgggcgtggtggtgggcgcctgtaatcccagctactcgggaggctgaggcagtagaatcgcttgaacctgggaggcggaggttgcagcgagccgagatcacgccattgcactccagccagggcgacagagggagactctatctcaaaaaaaaaaaaaaaaaaaagacacagccccagaaggccaggcatttcggctccagagctgggactccaccccagcctcctggaaatacccaaaatggccctctttggggctctgtgttcccacttcattttgaagacagggtgaaagtgtcaaggggcaccgtgtcatctccccactcaccccaaatagcagcagcagcggctcctgcagtagctaacattcttccagctgggtggctgacgttccctcggaaagcagggctgaaggcatcctcagagaatgccccgatgcccagggatctgggacggccatgggcttcacctgcacaggcacccctggcccaatcctcacagctgccactcccacactgctcccgatggaaattccagagctttacagaatcccctgttttatgaaaaggggtagacgtggcagctcaccccaggtcgcacagcctcatggccagccggggtttgaaccctggaccacctgcttcccccacacccaggggctttccagggggtgcctggagggggagggaagccgatgtttggtgggtgagcctccctgagtccatccgttttttgtttgtttgtttacttgcttgtttgtttttgagacagtttcacagtttcattcttgttgcctgggctggagtgcaatggcgtgatctcggcccactgcaacctctgccgcctgggttcaagcgattctcctgcctcagcctcccaagtagctgggattacaggcgtgagcccctgcacccgactatccatctgttttttgtgtttgtgatggagtcttgctctgtagccctggctggagtgtagtggcgtgatctcagctcactgcaacctctgcctcctgggttcaagcgattctcctgcctcagcctcccaagtagctgggattacaggcacccgccaccacacccacctaatttttgtatttttagtggagacagggtttcaccatgttggccaggctggtcttgaactcctggcctcaagtgatctgcccacctcagcctcccaaagcactgggattacaggcatgagccactgtgcctggcctctgtttcttcattcattgattcactgaggaaggtgtgaggggctgagctgctgagttgggggctgtgggggcttttgtcccaggcagcctgggaggtagtgaggcccctgtctgcagagtgatgccagcaagtcactgcagaggggggatgcacctcatttcagccccagggaggctccgttccttcctcccgcgtggacgagggaaggcagagctgagctggggcttgtctgtgcgcccttagccagtcagggtctaactggacttcggatctgactgtctctgccctccctgccaccttctctagggctcgggtgactcccaggtgatggggcagccctgagccttcccatttctctggaaggagagtaggcaagggccaggagcgaggcccaggggcacgtgttgatacccagctctccatcccccggctgtgccgccctggctagccccttctctgctctgagccttcgtttactcctctgtgtaatgggctcacagcctctccccctcaggattctggggtaagaggaggcggggtgatgaggcttcctatcccttcggaggctggctttggggaaggtccagggctcatggggtgtgaccagcctgtgactctctcgtcccatcccctccacaggcatctcgtccccggtgaagaagacagagatggacaagtcaccattcaacagcccgtccccccaggactctccccgcctctccagcttcacccagcaccaccggcccgtcatcgccgtgcacagcggtaagcgccacgggcccctggcggggaggggcggcgggccctcctatcaggcctctcacagccggggaagtcccactggatgtctgaccatgagtcctattgctgtagccttctaggtgggcaaaaaaccatagaggtgccgtagtggagagcgcccagggccttgttccagcccggctgagaggttggactcagtccctttgggcctcagtttcccccctgtataacaaaaggctgcaacctaacttcacctcactcccctcacccccgtctcaatctaatccccccattccaaccccagacactgatggacaggcaggatcagaagctgccaatgaggccaggcacagtggctcacacctgtaatcccggcactttgggaggctgaggcgggtggatcatctgaggtcaggagtttgagaccagcctggccaacatggtgaaaccccatctctactaaaaatacaaaaattagccaggcgtggtggcacgcacctgtagtcccagctactggggaggctgaggcaggagaattgcttgaacccgggaggtagaagttgcagtgagcagagatcacaccactgcactccagcctgggcaacagagtaagattccatctcaaaaaaaaaaaaaaaagctaggcttggtggctcatgcctgtaattctagcactttgagaggccgaggcaggcagatcacaaggtcaggagttcaagaccagcctggccaacatggtgaaaccccttgtctactaaaaatacaaaaattagccgagtgtggtggtatgcgcctgtagtcccagctacttgggaggctgaggcaggagaatcgcttgaacccaggaggcagaggttgcggtgaggcgagttcacgccattgcactccaacctgggcgacagagcaagaccctgtctccaaaaaaaggctaagtgcaagtggctcacgcctgtaatcccagcactttgggatttcaaggcgggcggattacgaggtcaggagattgagaccatcctggctaacatggtgaaaccccgtctctactaaaaatacaaaaaattatccgggcgtggtggcaggcgcctgtagtcccagctacttgggaggctgaggcaggagaatggcgtgaacccgggaggcggagcttgcagtgagccaagatcgtgccagtgcactccagcctgggtgacagagcgagactccatctcaaaaaaaaaaaaagagacatctccatctcggccaggcacagtggttcacacctgtaatcccagcactttgggaggccgaggcaggcggatcacctgaggtcaggagttcaagaccagcctggacaacatggtgaaatctcgtttctactaaaatacaaaaattagctcggtgtggtgatgcatgcctgtgatcccagctactcaggaggctgaggcacaagaatttcttgaacccgggaggcggaggctgcagtgagccaagattgtgccattgcactccagcctgggcaacagagcaagactccatctcaaaaaaaaacaaaacagaacaaacaaaaaatcaccttccatggttgccattgggattaaggggggtgaattgtaggaagcctcaaatattgcttaccaccccatgttctagtgatcaactatttagttctttacacagtcatgcacacagagaggcagtcccaaatcaaagcagccatttgggccaggggtcagcaaacgctggccccctggttgcctgttcttacgaataaagttttattggcaaacagccacgaccacgtctttgtatatgtcctgtggcagctctcaccctgtcttggcagggctgagtaattacagcagagaccacgtggccaaaagccaaaaatatttactatctggccagaggctgtggagatgagggagtgactgctataaatagtgaaaatactaaaaatcactgaactgtttagaaagaggaaaaggcaggcaccacaatagaatatgactcagccatgaaaacgcacgaggctctgacgcaggccaccttgaggacgtcatgctcagtaagagaagccagacaaaaaggccacacagcatgtgatctcatttctatgaaatgtccaggacagggccagccacagaggcaggaaggggatgtatgggtgctggggctgggggaggaggtgaggagtgacggctgatggagacggaatttctttatgtgctggaattaggccgggcacagtggctcatgcctgcaatcccagcactttgggaggctgaggtgggtggattgcttgagtccaggagtttgagaccagcttgggcaacatgatgaaaccccatctctactaaaaatacaaaaaattaaccaggcgtggtggcacacgccggcagtccgtgctactcaggccgaggcaggaggatcacctgaggtcaggaggtcaaggctgtagtgagccatgatcatgcccctgcactccagcctgggtgacaaagcgagattctatctcttaaaaaaaaaaaaaaaagatcactattcagccatttgcagaaagagcttgccaaccctagatttatagtgtagactgtggggccagatgggctgggttcaaattcccggtctgccatctgatgccgtgtggccccaggcaggtgacacatcccctgaaggccaccctgtcatcctctgtttaaaaaaaaaaaaaaaaagacggggccaggtgcagtggctcacgcctgcaatcccagctctttgggaggccaaagtgggcggatcacctgaggtcaggagttcaagaccagcctggccaacatggcgaaaccccatctctactaaaaatacaaaagttagccaggcatggcggcgtgcacttgtaatcccagctactcgggaggctgaggcagaattgcttgaacccaggaggtggaggttgcagtgagctgaggtcataccactgcactccagcctgggtgactgtctcaaaaaaaaaaaaaaaaaaaaaagaccaggctcagtgggttacacctgtaatccccgcactttgggaggcctaggagggaggatcgcttgagcccaggagttcgagacctgcctgggcaacatagcaagacccccacctctacaaaactaaaaaattaaattaaaacacaaggataatatcacagccccagtggggttgccgtgggagtcggggaatttgggtgtcaatgtggtcagtgctgctgggtttttttggtggttattgttactaaacgcactgagatgccggcaggaatgacacccacagacacacagtcacacggtcacagagcagaccggctggagcccccaagtaacccccgcttcccactgtctccgcagggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccggtgagttgggcggggcgcattcgggcctctcctggcggctccaggtgacctcccgggggccacgtgctcacacgaaggcacaacctctgcttaaaagggtcttgaggacttggctctgaagtcccctcctctgtcgtgctgggaggcagctggattgggtcagaattgagatgctttcggatgtcagggtttcgggcgcatcatgtcgcaccctgtggggtctgggtagcacccgtaggtcccagcaactgcgtgagtcgtactcatgttaacacaaggcagggagggactgggcatagcggctcatgcctgtgatcccagcgctttcggaggccaaggcgggaggattgcataagcccagagttcaagaccaacctgggcagcatagcgtgacccagtttctacaaaaaaaatacttaaaaatgagccacgcatggtggcgggcgcctgtagtcccagctactcaggaggctgaggtgggaggatcgcttgaacctgggaggtcgaggctgctgtgagctgtgattgtgccactgcaccccagcctgggtgacagaacgagaccctgtctcaaaaagaaaaaaaaggttggggggcggggggcaggaagacattgattacaaaaaaaccaccaaactcagttcgagcaagacagcgtttgccagactccacaggaagctttggatgttcagagcttttcggactttggaaccacgggccaggccgtggatgatggtggatgatggcgtgctcgcagtgaattaggaaaaacgcggagaacctgctgttaggaggcggtggcactgtttggaaggaaatcagtcgagttggcgtgcagggggtttacagaggagatgcagtgagcgtggccccagtagtgccgggctttgagtgacaccagcaagcgggtgtccccaggcccctccacctccggccgtcctcagacccaccaaacccgccatggtcacacccgcgccctggccccccagcctgccaccccgtccgggccgtgcacagagccgggggcggccggcgccagcagcccgaggtagagggggagcccaccccttaaccacgtgtctctctgttcccccagttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttgtaagcacgcgggaagcggtgccctggtggggcggatgtccgcaggggggcctgtcccctccccagccccactgccaggtcagaggtcaggcccgaccctgcagggcctggcgagtttggtgggtctccggaaaacagcccagtggccacgtggttgggcccatgtagggctgaggcagccttaggggctggccggaccaagcctcgggccagggtgagagtccagggtctgtccccttcgccgagtcacctgggggaccccggtgcccgccgtgggccgtcagaaaccctccctggtatgtcaggcagctgacagtggacacggatctcacagtggcggcccgagggccagactcgacccccagactggtcttttgtttgtggagaaagagaatcggttgttatcattttaaaatcaggacgttttacataaacatttccagagttctggcttcttggggagaaaggagctacaccaggcccagttcctttgggtgacctgggctggaccacacctttagatgggactctcttcgcctgtccacctgacctggaagcccctgggttggcggctgctgcaccttctagatttttctgctctctggatgtggttctgggtggctgctggatggcccctcggtcctggcatccctgtcctgaggtccaccccattcgtccgcagtggctctacccccagactctccccacgacccccatgcaggcttgggtgggtcacccaccctcacagggcgccagacatctctgaacccagagacctctccccatggactccatctgcccctcacccccctttttgagcatctctgtccctcactctccaaatgagaccccccaccccacccaagcagttggtggccacggttccttctaggtgccctcagctcctcttctccctgccccggcgttcctgtccccgtccccactgcgtgccagaacccaggctgcctgcccataaaaaccggcttctgatcactggctggaggagatcagccccaaatccaccctgggctggaatcccacctctgcagctctctcactgtgtgacctcaggcaggtgtcttcccctctctgagcctcagttttctcagctgcaaagtgggtttgccttggtgcccaattcacagggcagtgggggacaagccggtgacatgggtcagggaggcagagaggacattccatgtggcgcctgatgctgcgtggtgtcaggcagctgtggtcattcttgccggctgtccctgcctgctcatctgtgaaatgggagcgttgactgcataggatccagtcagggctcagtgggatcatgcccagagcctggtattcagtagacacttaataaatgcaggatactgcgtgggatccactcagggctcgatgggattatgcccagagcctggcatacagtagacacttaatagatgcaggatactgtgtaggatccactcagggctcggtgggattatgcccagtgcctggcatacagtagacacttaatagatgcaggatactgcgtaggatccactcagggctcggtgggattatgcccagagcctggcatacagtagacacttaataggtgcaggatactgtgtaggatccactcagggctcagtgggattatgcccagagcctggtatacaatagacacttaatagatgcaggatactgcttaggatccactcagggctcgatgagattatgcccagagcctggtttacagtagacacttaatagatgcaggatgctgcttaggatccactcagggctcggtgggattatgcccagagcctggtatacagtagacacttaatagatgcaggatgctgcttagtatccactcagggctcaacgggattatgcccagtgcctggcatacagtacacacttaataaatgcaggataggcatggattccacccccctttccctgcaccggggctcttaactgcaaatctactcctacttctccccataagcctcgctgcctccagctccccccaaccccagccaggacaacttggggaccctgcctgttgcagcttcttctccccctacctgggtcccggcctgtctgaggcccccatccctgctgtagccccaggccgtgagttactcacacgccgacaaaatataatcgctgaggctgaaatataaatacgcacatctgtatgtatgcacacacccagccctccctctgccctctccgggaggaagattaataaataaaacgccctcaataattcatgcaccccgcgcggaggcagccctcagtggcaggaccgggcgggcgctgcccaccctgaataattcacgggcggttttgtgaattacagagccatcctgccttccctctcagcagacaccccgcccacctgggcgatctcagccgtgacccccgggcccctcgagtcaggatccccgcctcccaaggaccttgggcctttcaggggggcccggttcaactgggggtagggcggcaggctcggaggccccaggcactgggtgcagaggcccggctgtgtgacgcctggcggtggccaccctctctggggccagggccgccccggctcccacaacccctcgctaacgggctctcggtctctctcctccctgcagcctactctccgcccgacacgtcccctgcaaaccgttcctttgtgggattaggaccaagggatcctgcgggcatttatcaggcacaggtaggggccgagaggccggctggtggggtgggaggggcagggcagaggggccggcccggggggctcagggcgaagagggcctgctgggtcccacgccacacccctggcacaggggcgccagcctcccacaccccacctgggcctcgagcccccacctggcctctccctgaggccaaatttccctccaccttggtcctggggggatggggtgtggccccagactcagcctgtggggtccccaggagcgtctctggagaccatcgtggtacagctatgggaccagtgtcattaccacctgcttcccatggtatagatgggaaaactgaggcccagagagacaagggggtctgcccagggtcacacagtgcatcaccctccctcctccagcctccatcccccatccacgccgaggcctagagggaccgcggggtggccgggggaaactgaggcagcccatggcggggcgtggggcctcccaggacagcatccaagcccccaccccaggcttcagcccacatctaagccagtgtgaggagtcagggcggagaggcttcgtcagcaggacagacaggatggggcaggggccagcgttcatgttcacgttgatgttcatagtcacgtacatgttcagacggctgcagctgagtgagcatggccggggtcccaccacccctagaaggcaggcaggcaggcaggaggttgacagaggaggctcagagaggggaagtcaattgcctgaggctgcacagtagtctagggagtgggggcgtgggagggcagccttagccccaggcccaggtgtccctcaccccccacccccataaggggctctgtgtaggccaggagtgtgtgagcgcgtcttcgggttatgggtaagcagctggacctttgagcctctgctctctccccggtttgtgttggggagagggttggaggatgtaggagtggctgccacaggcccgggaggtccagactcagagagaaacgagctctgggctacccagcggccacggaactgcagagcgtggagatgtatggggtccccaggggccgtgttcaaatcttccagccactgagggaggtttcctgctgcagagcccacgggcaagggtcacggggcctccccgggaccctgcggggctgtcctggctgagcggatgggggcggggaggggacatggcattccccctccctccctgtgctgggtgcccaggatgcctgtaagcggcccctccctctcttcccaggctccgcaaaaccagccggaggaggaagcagggatggaggctgcttctcctgagttcagaggagatccatgtgctatgggtggagggaatcctgggtcaggggccagggctccagcccagtgctggctcacccactctgaacctctgtctcttcctctggccttgggcacccgcaccaagagcctttgaagggcactgggggacagaaagggcactgaaaggttcaggcttccccacaccccgtaaatattaagtaccctgccttgcacccatagagccccggagagggagtaacttggtcagggtcccccagcgagcagacgtccaggactcctcgctttgggatttgggccccctatggccaacctctcccccgcctggtgctgatggagcccggcattacctctgccacccccaccccacatcgctccctgcccctgcgggaggctgggaacgtcttaagtggttcagaaaccaaagctaataaaagctgcggtgggaggaggcccagcccgcttaacccttccccagcctctgccttggaccaaactctctgaccaggccctcccgccagggcccgggacccttctctcagactgtgctggctccagccccaccccacccaagcctgggagggaagggaaactgaggcaggcaagggtggcacctttctcagcatccctatcttgactggctggactcctctggggacccagaaagggtgggaccagggctggcagaatggggtgtgggggggcactggcaaggggctcagcataggcaatggtgtgggtcgggggagggggagctggctggaatgtgagagatctccggtggcaggggccagacagatgatgcgggctttgctctggggtagtggggagccatagaagggtttagagggagggagtggacacccaccaggcctgggagtcagaactttctggagcacagaaaggaggtgacacattgtcaagaggctctcaggggagcatgggttagggggaaggcgaggtccccaaactgggcatccagggagcacaggtctggggaggaccccattgctgctgccctgactggactaagagcacctgggttgaggccgggcgccgccacctccctgcagaccccggagagagggagggaagaagcagtgagatcccgctctcccctctcccagctcccgctcaaagggccctgagcttggaggcctctcatttccgattctggccagtcagcacttctgcctccgcctcctctattcctggcggattcgcttccctctgccccctcctcccccaaagcctgggtgggcgcgcctttccctctgcctctccggctcccgacaccccccagtccatggactctccccccatcaatatccctccccgtgatctatgctaattgatctcgccctggtcagttacccacccatcgccccatgtccgtccctatcaatccccccactgtgaggctgggtggctctgacgccctggcccctcccctctgtgatgtccttcacgcccctacatttctcctgcacgggaacccacgtaagcagctgggtaaaccgagggtggggggcaaggcgggcattgagccacatgccgggagccacacaggcggctgcagccaggccagcaggataccagagcccaaacctcccccttcacacctactgcctcagtctcccctcagctgagtgggaggatgtggagttgagggtgcccccaccccacccccgccccattgctggggccacagccaggcaggaaggggaggggagggaagggaggagggaggaagggctgaggggaggctggtccaccacggggagggtcacgcccagagtctgtcggttgccaacagaaaccagacatgaggtaatggccaagatgaacttgaacttggctggaggtggggcgctgggaaccactgtggcgccagttccatgggctggcccagtggctgcctggttggaggggctctgttgaatgatttgctgcagcggtggggggcggccccacctctaacctcagttggggagtggaggggtctccccagttccagaggcacagccctcccctcacagtccaccctggatgctccatctggggttggagtttgcgtttccagggcaggggtctggacagcagcttctctgcagagactgaggccggagctgtccccaaatgacgtgaccttgggtacagccccatgcagaactcccctcccttagcctcggtctcccgcctctgggaggttgagagtcatcctcagcccccctgtgcttagtgagcttctgtggagcaagagggggccatccgggggacctgtgacaggatgggccctggacgcccaggacagtgctcagaagatgccaaggggattcctgagaggcaggcgagggggttggccctgggcaggagcagaaatgagagccagagccagacaggcctgagttcaagttccacctctgccgcttccatgctggtgacctcgggcaagttccttgacttctctgggcctcactttcttcacacaaaacagcggtggagggagacctaccccctccttcacggggataccggggacatcattaaagaggagaatttttttttgtttttttttggtttttttggtttttgttttgagacggagtcttatgctgcccaggctggagtgcaatggcacgatcttggctgactacaacctccgccccctggattcagacgattctgctgcctcagcctcccgagtagctgggattacaggcacgtgccaccacgcctggctaatttttgtatttttagtagagacagggtttcaccatgttggccaggctggtctcgaacccctgacctcaggtgatccacccaccttggtctcccaaagtactgggattacaggcatgagccaccgagcccagcctcttgtttactttttaaaaacattctcaaggccatgtgcagtggctcatgcctataatcccagcactttgggaggccaaagcaaacgaataagctgaggtcaggagtttgagaccagcctggccaacatggagaaaccccgtttctaccaaaaatacaaaaattagctgggtgtgatggcgcatgcgtgtaatcctagctactcgggaggctgaggcaagaaaatcacttgaacccgggaggcagaggttgcagtgagccaagatcgtgccactgcactccagcctggtgacaagagcgtgacgctgtctcaaaaaatcaacaaaaaacctctttataaagtgaacaaggcagctgatgtggtggctcatgtctgtaatcctagcactttgggaggaaggagttcaaggccagcctggtctacatggcgaaaccccacctctacaaaaaaaaaaaaaaaactagtcagatgtggtggaacatacctgtggtcccagctactcgggaggctgaggtgggaggatcacttgagcccaggagatggaggctgcagtgagctatgatggcaccactgcactccagcctgggcaacggagcaagaccctgtctcaaaataaaataataaattggctggccacagtggctcacgcctgtaatcccagcactttgggaggccaaggtgggcggatcacttgaggccaggaattcaagaccagcccggccaacatggcgaaacccggtctctactaagaatacaaaaattagctgggtgtggtggggcgggcctgtaatcccagctacttgggaggctaaggcacaaggatcacttgaacccaggaagcggaggttgtagagagccaagatcacaccactgcattccagcctgggcaacagagcaagactctgtctcataaataaataataaatagagaagaaaataatttttaaaatataaaataaaggccaggcagagtggctcacgcctgtaatcccagcactttgggaggccgaggcgggcggatcacgaggtcaagagagtgagaccatcctggccaacatggtgaaaccctgtctctactaaaaatataaaaattagctgagtgtggtggcatgcgcctgtaatcccagctactcgggaggctgaggcaggagaatcacttgaacctgggaggcagaggttgcaatgagccgagatcatgccactgcactccagcctggcaacagagcgagactctgtctcaataaataaataaataatataatataataaagtaagattgagttccagactgggagtgctggctcacacctgtaattccagcactttgggaggccgaggaaggtggatcacttgaggtcaggcgtttgagaccagcctggccaacatggtgaaaccccatctctactaaaaatacaaaaattatccaggtgtggcggtggacgcctgtaatcccagctactcgggaggctgaggtaggagaattgcttgaacccaggaggcagaggttgtagtgagccaatatcacgccattgcactccagcctgggcaacaagagcgaaactccatctcaaaaaataaaataataaataaaatataaaatacagttccagataaatggatcttttgtgtgtggtgtgtaagtatatccccaatgttgcgtgggctagacttatactaaaagaattctgtgttaaccagaactccagtttcactgggcatcctgtactgtgtctggaagcctccctcagagacaaagtcacttgccatgggtcacccagcaggttgttagagcctgggatggggaaactgaggtcacagggttgcaggaggtggggggtgagcgtgggaagaggtaaaccatgtctgcagcagagtctgacccctcgacttctctccctttttctctctccctctttctgtcgccactgggccactcagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagagcgagtggtttaagtgcctgattaccaccacccgcccccccctttgtccagctgggacacggaatggccgcgggcctcctccccctcccctccagcctctccaccagcccctccagtcaaccctcatcgccgtgcccccccagagctagagagatggggcccctgcgtggcccgaggggcagagctgggcgtcacttcgcaagcgtcctgccctgccggggcgcgggggtgggctctggggaagccggtgcgccccccacgcctccgctgccagtgccttacattctggagcgacccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtagggggcctcccatctgctaagcgtttttccgttgagccgctccaaaaacactaagctggggacgccaggtgcccccccaccccggctccctggccctatccacacctccacccccaccccaggatcgccatctttaggggaggcctgggagggggtgttaggtgttttagggccaccgagctcaaacacaaggacccctccccggcccacccagcccagccccaactgacctccatgcctagggaaaaactccccccaccactgccccctcccccgacccaggccaaagccagggcaggtctccgggtctcacctgctcctagcctcacccccctgcccccgaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggccagccgggctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatctaaaaaaaaaaaaaaaaaaaaaaaaggaagaaaaaccacgctaaaaatcaagccactgaaaacaattgcccccaggtctacccagcccctggctgtccttggtcctgtctcccctcctgctgtattcaggggtgccccctggtgctcagcctctaccacccccaaccctgctcttgggtacccagaggggtcatttctgaatcccttgcccagaggacagacctccggggcccatcttggccctgggaaagggctctcctctctgattggtccctaggccacgggccggcccccagacaccattcaccgacccactgcaggctgtcctccaaccatggggtggccactccacccgcagccagactccccgctccccacttttcatgcaggctggcatacccctggctcagggtcaaatgctgttccacacccacctcagaggcaccccctctcccctgccccgtgcatccccacccttcttgccaaaggacctcttttcccctatccagagaccaccccaggtggcattctctcccaccttctcctttgtcccccatcccctgtctctgtcttccagctgtgaatatgaagggtatcctgtatgaaacaaaaacaaaacctgatatatgcaatatctgtctgtctgtctgtacccatgggcctggctcagccattggaggcccagccgagggtccggcagggcacagggacagccaggtggcaccgagtcacaggctgtggtccggtggctgagcatgctgttgtcttgtccttgattttattttcttttgttctttttttttttcttttctttttgtttttaactccagcttcctttgctttttacttgaccaaagctaagacaatagccagatggttagtggggcagccaggcagggaggacccagggctgggattctccaaccttaggccattcctgcagccctcaccacctccagcccctccaagcatctcgtgtagggacccacgcagatggtcccattcattcactattgcccccaaccccgggattttgggtggtctccacagccaccatcatacactcatcccgtgttttcttccaaaaagtcacctcagcagcctccccaggcgatacagagggagagcccagaccaccacagctggccacgacattgcccttaagtaatatgcattggccagagagcccgggctggctgtgcacagcattcatgtagctgatttctagctttttttttttttctgccccactcctgagcaaatctgtcttgccaaggaactaggagcaaccggaggcaaagggagtgggtggccccatcactattgggaccatcgcgtccctgcacagcccacacccgggggcccagagtcctgggctggacgccacccttctcaccccgagcttgcctccttggctcacttggcaccttggctgagtacagcaggcaaaagcccataccaggcagcatgttgtggatggtttagttctccccgcctccctgtttcttggaaaagctacagggtccctgtagggcaaaattcccaggcgccttgctgcagacagagtaagacaaaaacaccaggaagcaggattccgtgcccatctctgcagtttgggttcacaaaagggggtgccgtcatccctgggtggaggagggagtgttggttttttgtttttgtttttttaacatgtatgaaactgacatcttctcaaatcttgttccacccccctctggaagcccccatcacccacccctgctatggacaccacacctatgccaggcccccccccccaccccagtctcattctggggtctgcccatgctgtgggaaagaatagggaggcctcccaaatatatgcaaattgtccccattccgtgggggcacctgacaatgacccgggtggagatggggcatggaggagtaggaagacccagccctatttgactggggagaggaggatctggagtccttcatgcccaggtctggaacccaggttctgaccccagggccccaccctgggctggacaatcagatcccaaaggaatgccaaaggggactcggttgggagagccgcttaggggccagacctgggtccccctgcaggtccccaggcagcagacaattccaccttccctgccccaggaccttgagagacagcagcattccaggcacagacagacttggctgcaccccactgtcccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccctgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattatgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaacaaaaaaaaaagaaaaaagaaaaaaatgtataaaaattaaacaagctatgcttcgactctt

SEQ ID NO: 828 - DNA, 109656 bp, Homo sapiens
cgctcgctccctcccccgcgcgccctccctcgccgcctcctcccgccgcctgcggcccccccctcgccggggaccgagcgcgctcgctccggcgccggcctcgcctcctcgcagcagcgccatggtacgtcgccgcacccactttcgttttcgcccggggactttttggggtggtgcgtgggctccgggcgaaagttgcaagatctggggggacagggggcgggggccgcccggaggaggggctcgaggcggggacccccactcgccagtcgccacgggacccctacccacgatccccccccgcaccccggctgggggcggagctggcgcgcggggcgccgcgggagaccccaagtggggggcccctcgcgggcgccgcgagttggcgaggagggcggggctccccggagaaggcccccgcaaccccaggccgggcccccgccccctccccgggccagaccccaggcgggagggcgcggccctgggcgcacgacccccgagcgcgcagtccgtgggggagcccgggccagggagggggcgcacggcgggacggcgcgtggggcgggggtcgcggcggcccccgcggggtgccccggcccgggcgagcgcggcgcgccagctagcggaaaatggccgctgcggagaggggcggagagcgcgccgcggccgccgccgggcgccttgaacttggagccgggcgggcggccgcgctcggcgccgcgcaggagcagccgccccgcctgccctcgcaccgcccccgccccgcccctcggcagacccccggccccgctgccgcgcgcgcggggtccccagctgggagggacccccgggtctcggcccggcgcgccccaggccctggagcggcggtggctgcacttggggttccggtgtccggtcgactggcgtcggtgtcgtgcgcacctcgaggggtgcgtgggagcccctgcgctccgtaacgggccggcattggcatctgggggagcgtctggggtgtgcgcggcggggtggtagtgtacctgccttggggccgcgggtcccggcgcgtcggctccgccgctttctgtgtccgcgtgtgtctgcacatccacgtgctggcgcgtgttgtgttgtgagcgccgcccgcattgtgcggctgcgggacacttgtgtctttggataactgggcgactgtgcgcgcgtccctgcgggacggtgttgtgaaactatggctgggctgcgtgtccgcggagccgcgtgtccctgggtgaccgtggggtgtccccgtgtgggtgtgtggcggttggggggggtcgccagggagtggagaactgtcgagtggccgcgttccaggggacagttgggtgccgcttgctgtgtgcgagtgactggcgctgagcctccccctagggaagggtctgccttccactcccggcctcgcctcccccagttccttttttcctgtaactggggactgcctgggcggcggaggaagagcgctccctccaccttttcaaaactctgtccctttatctttcccctacgtcccctccacttcccccagccttcggggtcccccatccgcttggcccgagggggtcctggctggaggttcgggcgcgaggtggcgccgggacgcgatcactcggcacgcagacgtcgctcgccaggggttgcgcttgcgcggggacctgccccgagaggggcggggcggcaggggttccccctccctgagaggccgtggaagtcccgaggggtgggtggttacagcagcacaggggttaggacgggcccgggaggtggctaaggagacccctattatcctatgctggggagagcgtaggggcaccgggactggtcccgcagtcccgcctccagcacttgcccccaatggaccagaggccgtgggcacagagagctgttttgtcacctccagggaaatccccgccgctctccacccccaccccacccccagtgcgtttgatataattttctaaatataaaaagcccaaggccaggctggtctctctcgctttcttcttgacatcccatcatggggggctgtttgggatgtcaagaaggagagaaaaccctcccacaatgacacagaggcctcccccaacaacactcaaggtcattctcgggttgtcaccatccctcacacccactcccagcctcagactcacagctatctccctccgcactcccggagggacggttggatgccctggccttcagcacacggcatggccctctgtccccattttgggttctgtgcacagtgggacacacgtgcatgcagtcatagttacacacacacacacacgacactccctcacggtgcctgtgtctgcatgactctgcacacacaaccacacagagactcacatagacacacacaggcctgtctagagacagacgtcacacacacaggcgtgcacagacacacatgggcagacacactcacggacacaaacaccgcacttgcggggggatagacaaccacatctcaccctcctgcccttccctgtccccaccgcgtttctgcagggccgagagcccagctccaggcagagctggtgcaggaggagcagggaggtggcgtgctgtgtgtcattgtgatggtgcgtatgtgactctgtgtgtgcctgtatgggaataccggggggttccacttgtgggtgtgtgtgtgcttgtaagagtgtgtgcttttgtgtggagtgtgtctgtgattgtggacaagtgcccatgtgtttgtggttgtgtctgcacttgtgtgggggcagctatatccatgcgttgtgcttgtcaagaagcgtcctgtggggagttgggagggtgtgtttgtggctgtgtgtgtgccatgtgggtctgtgtgtgtgtgtgtgtgtctctgctcgcccctctttgaggaggtatctgaggtcaggtgtggggggaaggctgtgatgatatatgggtctgtttttatgtgagtctgtgcgtgtatttgtgtctttgtgtatgtagctgtgtgtcgtgtggagtctgtgtctgcagctgcttgagtctgcacgatgtgtgtctgtgtgtctctgtaggtcgtagtgtgtggtgtgtgtgtctatctgtaccagcctcaacggcctatctgacctttaactcacttgactttaacatcccttcttacagcctcagtttctcatctgtaaaatgggaccacatgggacccttgcaaggttcctggggagctgacattgtgagccccttgctgagcaggtgcggggctaggggaggctgactgcacactgcactgctgtgtaatcatttgcctgcaagattatgtcctttattctctgggtgtggtggctgtggggttaccatggggggctgggggttcctgtctaccctgcctgagctgctctgtgaattgcattcaactttttaagttttcctttaattactgaagccattagtgatcatatgaagaggatacaactgtatccagaggaaaaaaaatccaatctttctgatcacccccattcctgggtggaaccccgctccagaatgttaccatctatagttggagcatttgcaggactgagaaatacacacttatagaggatacatgtgcatatgtgtatatttccataaaggatgtacttgtggaaatactcgtgtatttccataaaggagacatatgtatatgtatgtgtatgtgtgtgtatatatatatatatatatatatatatattttttttttttttttttttgagatggagtttcgctctgttgcccaggctggagtgcaatggcatgatcctggctcactgcaacctccacctcccgagttcaagcgaacctccagcctcagcctcccgagtagctgacattacaggcaccctcgcccatgcccggctaatttttgtaattttagtagagacggggtttcgccatgttggccaggctgattttaaactcctgacctcaagtgatctgcctgcctcggcctcccaaagtgttgggattacaggcgtgagccactacaaccggccaaaggagatatgtgtgtgtgtgggtgtgtgtgcatgtgtgtgtatgtaaaggatactatgtatatttgtataaatacatgtgtactctttaaaaccctaaatgagatcttgaatttccttgctgggtctacagcagtggggtctcagccagggttgattctgttcccatgggacacttagccatgtctaaggacatttgtggttgtcacgactggggggtgcccctggcatggagtgggtggaggccatggactctgctcagcaccctgcagggcccaggacggccccaacccagagagcgatccagccccagtgtccacagtgccaagggggagagctctccagctttctgtccccccacttgtctcttggggacataaccagttgggagccactggttttactcagctgcatagtgtcccagcctgtgttgggattactaaaccggtcccccacagatggacagcatggctgcctccaaattgtgggcattagttttataggtggcagtcaactcttttgtgctcctgtatctgggacagttacagagatgccgaagagtgaaataactgtagagagagtgctttgaaaaaaaaaaaaaatgagccagattgtgctcgaaagtgccaggagctaaatcatgcacccatcttccgggccctccacatgcaggtcccaatctaccaattgcctttttaaagaaactatgacgtacagttccctgttgtaaccacgggcaggtatttgctgacttgcctacaacctggagggttatgagctggcgtcgccccatttcacagagggagagccgaggtgcagagagacgaagctgctgactggaggagacatagacccaagcagcgagcccacgcggcaatttagggaaccaactgtgtgtgctgcgggggtcccttgccacccaaactgggatataggctgctgttcgtacacttgcagaagtttctccctgcagctaccgccaccaataatattcacacagccttcccacatgctatgtaaagactccaaccttccccacctcccaagatgcatcctgttactatagccattttacagatgaggaaaccgaggttccaagaggggcagtctctgctctctaaacttcaccttccaaaggattctaagctgctgaatgaaggctgcaggcagggtggtctgtacaggggagggagggtggaaggcacggggtctggaagtctaggaggagtgtctgaagtcaactgcaacttttaaatatctgtgaattttagatttcaccctgtatgtgtccctagcgtgttttaataaaataaattgcttcacgttatattggtatgtggatttccagatacacttctcaccatttaattcaaatgctccccacagctgcacagtgggtttaaaatacacagacacacacatttatggaccgttcgtgatgtactaagcactgtttgaataatgtcaccgtcatgcagaggggagcctgtggggggcctagggaacctacgctgcaggaattctgctccctcctagtttacctgtcagaccctgggcaagtggcttccgttctctgggcctcagtttcctctcctgtaatgcctgaggataatgggtgctggtatcttctgcgcccctgggcctggggcacctgccccagcttggtgagagggtatcatttgtccttgggaagctcagagagatgaggtgaaatggccaagctttctaagaatgtgtctttagtgaacatttgacccaaggtcaaggctctgctaaggtcattgtccttatccccagcaatcccacaggatgggcatctttaagccactttataggggagaacccttgggatgggaatgagagacacagcagcctctgagctagcctgggaggatccagggagtgaaccgggggagggttggggccctgtcatcagatgccctgggggctcagacggaggcaggccaggtctctgccctgttacgtctagaaggagaacagaatgtgggctccaggtccagatggcctggctccaagccacacttgccatacctcagtcttgagatctgtgaaaagggcacacccctgaggcaggtggaaattattggatacccagggggaggctgcaagggtttatctggccagctggagatcccgcctggacaccgtcctcctggggtgctggagagacacacaggcgaggccacccctcccctgccccttgggtgctgggtgaagagagcaaattctggagcctcccgtgttagcctgggcccttctggccaaggaagggacagctgcacacaagcccctctagctggggacccgcagcccctgcctggctctggggggagaagggagccagggtgctgtgggaccagctcaccgtgcacccagggtcgtacatctttaaggggaaagaggcgcgctggccggcctctgcgcacgtcacttcttcattccttccctcccccctggctctttcctccaacttcccggccagctcgggggtgatgggggggtggggagggggggccttaaaaatccacccctggcccctcaatgtccagaaacaaccctgtcccccctctccgcttgatccgaattggggtcgccctgcagtcctggggtcctggtctagtgccctggggcattgcgtaaatacgggaggagcgggggggtcctgagacgtcgggggaggctctcctttctcgctcgcgcccttttttccctcgtttctttgaaagttgggtgttgagaagtgggaggttcggggtgggagggggagggtgtcagagggtagagagagagacagagagacagagacgggggagagaggaagagagagacggagggagagagggacagagagcgaggcgggcggcgcgagagagggagagcaggagggaggaggagggagaccgagggaggaggcggcgaggagagcgcgccggccgcggggcgggggggggggttggggggggcgggggggtggtttggaaaaatgactcagtaagttcagcgcgcccgctccggccggccctgcgcctcccgccgcgcccgggatgtattcgtccccgctctgcctcacccaggtacggtcctcgcccggccccccgccggcgcccccgcgccccccgcatcccagccccggagttttgaagcaggaggaggcgggacgaaaaaggcgcgcgtccctcccgccatccctgcccgggatgccccccgcgccgagggctggggtccggtggggggatgggtcaggctggggtaccccccccacacccttacctaccgcggaccccctacgcgggactcccgcccagcacccccaaccccgactctcgggacctctcccggatgtggggcttggtctgcagatttgcgtcccccccccacacaccgacgcactccgcacccccgccccgacactcggaaaggtcggggtgggggctggcccccctccagcaagggctctgcgggaagccccccgcctgcctctgagaggaatctagggggtcgtgattggaccctgggtctccccagctggagagaaagggacctctcatgtgttttccccgtgtccccccaccaaggttgtgcgggccgccctggccctcggtcgcctttccctcgttattggcccacgtgtgcatggagggggagggggcaggagaagttggaggcccaggagggggaagggtgctccggcggcccggctgggtcccccctcctttgcaagccccccagcaccgtcccggtattttcgctgcatcgattctggattctggattctggattctggagccgccgccgggaggagcgggaggcccggcgctccgggtctggcccgggcactgcggcgctgcggacgccctcgccagcccggcacctgccccgtcccctccccctccccctccccctcccgtagcctctcacccctggccgcactcccagactgccccggggccgagccttgtgcaatggccgagggggtgtgtggggagggggcggctccccccggggactccttccagcccaggctcccggggaccccgaggtctgcaagttccgttttctagaccgctgctttcctccttacgcagtgtgtctttaggctggagaggttctggcctcagtttcccctgaagtgaggtgcggctaaggccggttctggagaggggacagtatggcgggcaaactgtaaagtcccggcacgtggggggtgcgattccagcgagggccaggcccgtcttaagaagcactgtgtggggagtatatgagtccccggcttccgctccagggcatggtgcagtgagggaccccccacgccaggcatgctccttggtagggtctttctcaccggccccctgcagccgacagggaatgtgggagctggtgctgagggggtctgaggtctgtcctacctgtgatcccctgagtgaccttgggtaagtccctgtcccagcctcagtttccctttctgagcagctttggggggggggttcccgaagaaggcatctctttgaagttctccaagaacaactagggttcgagtgggcacgctgtgtgacctcgggcagcctttgaagtctctgggcttgtggggtgactgaggtgtccccgctctgtcctcaccagctggaaggagccatttgggagggctgagcggaggggaggctgttccaggctggggaggttggaaggctgcctgtgcaccctggaattcccccatcagggctggttgggagacatcctggttgctggggtgggttgggggttagtaagaaccccagtccaggctttgcctcagagaattgctaactcggcctcagtttctccaggaacagggcaaggaccagccaggagggctgtctgtggaaaccaaaaaacggagaggctaaaaactaaaaactatccaggggtgctgcgtgcaagagacagagatgagaagacagagacaggcagagagacagaggcagagagctcccaggccagagtggggacagcgagtcccaagtgcagggggctccctcctcccctgcgattctcctctctgccccgccctccaccccagccctgtagtggagctggggaccccctttccagtttgtcttcagcctgaatgtaatccccactgttcccccaaggcccagcctggtctggggtagccagtggggtgggctgggggactcagaaggaccctgagtgccccatgcaggagcctcccacccaagtcctggctgcctgactcagtttcccgaatcacgtcccctccgtttctctcatcttggtctctttttgtctgtctttctctctttctctctgtcttgctctgactctgtgtgtgtgtgtgtgtgtgtgtgtgtgtgtgtgtctgtttctccctgtctctccatctctgtctctccccgcctctgtttcactcccagtcactgttggtctctttgtgtctctctttctcatcctctgtctctctgatgtctcagtctctcccactgtctctgtctcttcatgtctatctcaccatccctttctcctctttgtctctgcatgtctctttgatgtgtctctgtctctctgtctctccctccctttgccttctttgtgtgtctgtccgatgtgtctctgtctgtttctctgtctctgtctctctgcccccttcctctctgtctctgtttctctccaatatgtctgtctgtctcttcatctctgtctcaccttccctttctcctctgtctctgcgtgtctccccttgccccctctctccctgtctctctctatctctgcatgtgtctccttactcctctctctctgtctctctctgtctctgggcctccctctcccccttttcccagctaattttacaacctgagcccaaccgaaaatagctcccttttagctgatccgacccggatccttctcgggagccgaggctggcggggggtggggggcatctcggtgccagcccgctctgtgccacccgggcccggcccgccgagtggggagtgggtgctggcggccctggggcattctgggagccccgggccgggctcagcggtgactcaagcgctttttcacttttactcttaagaggaactgtgtggagcccatggctcccataaatcctgccggcgggaaggccggcctccccgcgcctgctctgggcctccctccctgcctccctcccgctggcgccaccgccacgttagttattccgggtttggggccaagtccctcttggccgcagcgtggcggattccccgagccacctccatcccgccaccgggtccctgtctcattcgttcgttgtttccttcattcgttcgtcccatgccctctcggagcacaatgtgctttgctgccatttctccagcagggtaaccgaggctgggagaggctgtcctcccaccccagacccccgacctttgttggattttctagatcttccttaagcatctcctgggccctggggataggtgggggtgggggaggcagcagggcccaggcccagtgtaggttcttagagggagcttggggggtgcctaccaggagcagggggcctgcagcccctcagtgccgggagaggggctaagagtcagagagggccagggcctgcccgaggtggcacagtggggctggcagagctggggttcaggccattttccatctggcggcttgggcaggtgggcgctctctccccgtgtgccccccacccggggcctggtggcctctgattcactctctacaaggctccaccactctcccgctgtatctccctctgggtctctctgtgcatctctctctgtttctccccctcccctctctgcggcggaggtgcctctgcgcgccagggccaagcgccctgtaaatcaccaaagctgggattctggcagagtcagcgttctcctctctctctctctctctctctgtctccctccctttctccccccatctcgctctctcctcctctctccctctctccttctctgtctccctttccgtctttccctcttcctttctctctctctccccgtctcccttctctccctctctccttctctcttctctctctctttctccctccctacctccctctctgttcctcttctttctctctgtctgtctctttctttctccctcccttcctctctctctgttcctcctcttctttctctctctctgtctctctgagctggcctccctccctgtctcacaccaaatggatgggaaatgctgcctgggcctcctgccccggacacggcccgccccccactctcctgcctgtgtccacgccgacctcacctgggtgcccatctgccctgagcacacagcgtgcgggcacccaagtcctgaccagttcacatccatgagcacacgctgggcgcacacgcgtgcacactccctgacacccatacggacgaggacacagctctgcctgcctcggatctgccttgatgggggtcaccaacacacagacctagagtgcccctcacatctgcctgaaaatcttgctcaggaggtgccaaacccaatatagtacctggtatagagaaggtgccaaataactgctatagagtggtgccaaataagtgttgctgtgcttgtgattgttgctaaactaattctcctctttcctgactctggtgggtgacctgcccccacccccggaccgtttcttgccctgaaatgaagtcagcagaaacccccacttcctcagggctgctgcagattcagggaggcagcacaatttttttttttttttttttttgaggtagagtctcgctctgtcgcccaggctggagtgcagcggtgcgatcttggctcactgcagcctccggggaggcaggacatttctgaggtccacagtgcagggcttggtactcagtaggtgcccaataaatacctgttgcacgaatgaatgaatgaatgaatgaatgaatgaatgtttttggttgagaggcgggactttggtcttcccgagcctccatttctccgccaacataaaataaaaaacataatggcactttcctcagagacatcgatgtaccttagtccgacacctggtatacagtaggtgccaaataagtgctgctgtgcttatggttgttgctaaactagtaattgcattgaacaccccagaggcattttccagtttccctcccttccctctgtgtgtatttgcgcagcgtaagcccagctttgggctgggtgacaaggacagtggtgacctggaaaggcccaggctcagacccctctctactgtggcatttctgttagtttttcttttctttcttttttctttctctctccttccttccttccttccttccttccttccttccttccttccttccttccttccttccctccctccctccctccttccttctttccttctctttctctctctctccctctctctccctctctctctctctctctctctctctctctctctctctctctctcggagtcttgcactgtcgcccaggctggagtgcagtggcgtgatctcagctcactgcaacctccgcctcctgggttcacgcgattctcctacctcagcctcccaagtagctggaattacaggcacgtgccaccacgcctggctaacttttgtatttttagtagagacggggtttcaccatgttggccaggctggtctcaaactcctgacctcaggtgatccacctgcctcggcctcccaaagtgctgggattacaggcatgagccaccgtgcccggcctctgttagtcttttctccctgcccagccctgtccagggtctccctgagtttgaccagccctgtgtgggtaccagccttccttacacatgggggtgcatggataaggggggtcccagaggcagaagatgggagcattgcttcagtggtctggatgctggagatgctaacagatcaaagctgtgcccttgtgggaccgacagtctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcccgagactgtttgctcaaggggcccaggagtggggtgggggggtgccaggaggcccagggaccagtcccagctcagttcctccctgactgtgtgactttggtggaagatttcatgcctcagtctcctcctcgaggtagtgggtgcaatgatagtccccactttcatagtagactttttttttttttgaaacagagtctcgctctgtcgcccagactagagtgcagtagcacaatctgggctcactgcaacctccgcctcccgggttcaagcgattttcccgcctcagcttcccaagtagatgggattgcaggtgtgtgtcaccgcacctggctaattttggtgtttttagtagagatggggtttcaccatgttggccaggctggtcttgaactcctgacctcaggtgatccgcccgcctcggcctcccaaagtgctgggattacaggtgtgagccaccgcgcccggcccctatttcgtagtagacgtgatagctcagcaaacgctcagcctgtaagaggcacagcctcgctccctgcctctctcctccacctcctggcccctctggctcagccctcattgtcctcccagaacatcaaggcacagagggaagtaggggacccagggttcattttgctgactcactgccttggcagagagtttgaaccctgtggactcagtttacccaaattcctcactgtggcccacaaggccctgcccagcctgtccttgtcccctcctcaaccctcccctcctctctctttcccccttgctcattctgctccagccacatgggcctcctcgctgttcctctaacacgccaggtgcggtcctgccccagggcctttgcatgacccatttctccatcagaaagctcctggcctggagtgccatctctcaagactttgttcaggtgtctcctcctgcaagagaccttcctggaccccccccccaagctaaaaaacaccccccaccccagagattctctggtccctcaaactcttaaatttcttcagagcactttgcccaacttgacgttttattacatattttgctgattttaaccatccgtccctgccccagatctggatccaggtgagggccgagcccaggtccctgccaagtcctcggcaccctacctgggaccggcatgcagcaggcactcactaaatgtttgctgagcaacagaatgaatcttccctctctgggagccgttcacatgtccacaggctgtgattttctgagccaggggaaggagcggcccaaggttagagcctgacgctggtgccggatgggcctggggttgtccgtgggaccatggacaagtcatccgacccggagaagaaggcattagaactaaggctttgaaggatgcgtaggaatttgggataagtgctaagtaggtaatgagctagattctcatgaaggattgttgagtcacttttacctggaaacttttggtttggaaattggagtttcttgtcctggtttgctggcctggactttcagggtgggaggagcacagggaggtgagtgagggcatcacccagtgcatggcgtggtcgttcagcaaggtcttgggtccagatgtctctcccagctgctgctgctctctttggccaggaagtcccagtgggctaagctggggtttccaggaaagacctagccttgttccccttctccccatcaccttgcaaggaacaaggtcaccaggcaagctcccctgtctccagcaggctgcaatattcctttctgcccattgtacagaatgagagactgaggcttatctgaggtgatctgttccccagccattcagatggtgaaaatagaccttactgtcacccagccaccttctccgacagtgggtgcctcaactctgggcctcaggattggagagggagaggtgatagaactggatggtcctggctagatctgggaaaccctgggttgaggaggaaaggctgcttgaaggaggggacactagagatagggcgttgagggatgtgtaggagtttgggaggattttcagcatctagcttgtcttggttatctcttttgccggttgggcctctgagggcagtaggaggtccctggggaagaggccctggttattgcaggtcatgtgggagaaacagagtgacaaccggccaaccaggccctgcctctcacgtggtctgatcccctggggaggacaagggaggatggggcagcaggtccatgacccagttacaagctgtttgtcttcctgcctctgtaactagccggggtcaccactgacgtgggcccccacccctgcccgcctccctggcacctgtccccggaaagggcacagagaaggggaggaacatagagaagggagggacagttagggaggaggaagggaactcagatctacgaggggccagatgagaaaaggaattaagaggagaggggaagtggggagggggaattcagagagagaggggggttggggagagaaggagttggggggacagtgatccctgcccccatcatggatgcctcccctgtcccttccagcagcctcttatcacagccccagtaagcgccagagcttgggtggcagccacggccccagctggacaacattgtccgggcctcctgcccgcctggcatctcctccacaggcaggtcctgcgcctctatgggtcctctctgccgcgtcccactgtgccccccaccacccccactgcccggcttccctggccagaccatctgggctctggtcccagctctgctgaccggctgtgtgaccctggacaaaccactccccatctctgggtctcatccagtcaggggcagggacgagattggacagggcctgggccgggccccctccacctcccctttgccttagcaggttggctggggaagcgggggcagcggaaaagggccctgaggtccggtccccgccgcagctgttacggtgactcacgctttgggggacattggggtgggggagcttcgctggtacaagctgactctggtctcactgggtggggaggctattttcagagcctcagtaataggtgaaatctgatgtcctgcccctccccccgaagcaccccacggccggaggtggcccaaggggacgtggagcacagagcagggagggtgatctggcagcagctgctctgcccatcccggcctggaaatgggaccgagtccagccacatccgctggcacacacagtgggagtccagggtcaacgtctccctaccttcctgagaccccaatcttacagagaacaggctgttctgagaaagggacccgtggccttccagggggtcagggccctgattcttatcctcacaccggccctgagaccctgtgggacctcagccaggtctccgcccctctctgagccttagtttccatgccacagaacacggagcggggcctcaggctgttccctgcttcctggaagattgtctgcaatcaaaatgatcatcgcagcaatcgcgtccatagtaatgaaaataccccagcatcttagaggggccgaggcgggaggatcgcttgagcccaggaattcgagaccagcctgggcaacatagcaagacccccatctctactaaaagtacaaaaattagctgggcatggtggcgcacctggaatcccagctactcgggaggctgagacatgagaatcgcctgaacccaggaggcggaggttgcagtgagctgagatcatgccaccgccctccagcctgggcaacagtgtgagacactgtctcaaaaaaaaaaaaaaaaaaaaaaaaaaaaaaaggaaagaaaatagaaaatatcccagtgccttaggaggccgaggtgggaggatcacttgagcccaggagtttgagaccggccaaggcaacacagtgagtgagactccatctctgcaaaaataaaaattagccagacatggtggtttgcacctgtagtcccagctactcaggaagctgacgtgggagaatcgcttgagtctgggagttcagggcccaagtgacctaagatcgtgccactgcactccagtgagacgcctgtcttttttatttatttatttatttattttgagacggagtctcgctcttgttgcccaggctggagtgcaatggcgcgaccttggctcactgcaacctctgcctcccgggttcaagtgattctcctgccttagcctcccgagtagctgggattacaggcgcctgtcaccatacctggctaattttttgtgtttttagtagagatggggtttcgccatgttggccaggctgatctcaaactcctgacctcagatgatccacccacctcggcctcccaaagtgctgggattacaggcgtgagccaccacaccaggctgagacccccatctcttaaaaaaaaaagtaataaaaatcacagtagccccagcactttgggaggccgaggcaggcggatcacgaggtcaggacattgagaccatcctggctaacacagtgaacccccgtctctactaaaaaaaaaaatacaaaaaattagttgggcatggtggcgggtgcctgtagtcccagctattcaggaggctgaggcaggagaatggcgtgaacccgggaggtagagtttgcagtgagctgagatcgcatcactgcactctagcctgggtgacagagcgagactctgtctcaaaaaaaaaaaaaaaaaaaaaaaatccaatagcaatataagttgtaatgataacaatcatcgcatcattaataacaatgtagtcctttgagagctggggggaggaaaacagctttctgtgctaggaagggatcacccctgtccgaaatgcccagcccagcctggtcaaggcagggagatggaaaggcagttttgcttctctttctcttcttgttccttgtatttattccaccttgaggctgagaaactaggtcccagatgtttttaatttgttttattttattttttatttttttagagacagggtcttactctatcccccaggctggagtgcagtggcacaatcacagctcactgcagcctcgacctctgaggctcaagtgatcctcccacctcagcctcctaagtagctaggactacaggtgtgcgccacagcaactatgcccaactaattatttttgtaatttttagtagagacggggtttcgacatgttggtcaggctgctctcaaacacttgggctcaagtgatctctccacctcggcctcccaagtagctgggactacagacgcgcaccacaaaaattatgcccagctaatttttgtaattttcgtaaagatagggttttgcctgccggccacagtggctcacacctgtaatcccagcactttgggaggcagaggcaggtggaccacctgaggtcaggagttcaagaccagcctggccaacatggtgaaaccccatctctactaaaaatacaaaaattagctgggcatgatagtgtgtggctgtaatagtgtgtgcctgtaatcccagctactcgggaggctgaggcaggagaatctcttgaacctgggaggcggaggttgcagtgagccgagattgtgccactgcactccagcctgggtgacaagagtgaaactctgtctcaaaaaaaaaaaaaaaaaaaaggagatggggtttcgccatgttgcccaggctgggattgaactgggctcaagtgatccacccacctcagcctcccaaagttctgggattacaggcgttagccatagtccccagctgagatcccaaatgctatgcagactcagtttcccttgctggaaaatgggaagaatgggaggggcctccccacacccagacagggagctgggggcctcccactgccccacatttctcttcaaggggctgctgttattttcgtggggaagtcagatgagtgcaggttccagtccacctctgtcccccatggccgggttccccctcaaggcctcagtttcctcatctgtagcatgggtgttgtgactgccctcagacaccaatttgtcatgatttgggagtaggttgaagtcccagctctggcccagtctcagcgccttcccagccctcggattttccatctccagggtgggtctgcagggaacggggtggcccctctccccagttctgaacctttgtggctgagcgtctgcttctctggtctgtttctgtatcagcacagtgggttcatggaaaggggaaaggagggagaggactccacccgggatttctcctccctctgattaatcctggtgcacttgaatctcttatcttttgatgcagaaatccccccacccttccagcagccctcaacctccaggcgggcctagtgtctgcctgtggatctcagccaggcctgtctgtacatatgctctgtaggaacaagctttcgtagtcattttttgtttttttgttttttgttttcccaagatggagtctcgccctgtcacccaggctggagtacagtggagtgaccttggctcactgcaacctccacctcccaggttcaagcaattctcctgcctcagcctcccaagtagctgggattacagtcatgcgccaccacgcctggctaatttttgtatttttagtagagacagagtttcaccatgttagccaggctggtcttgaactcctgacttcttgatctgcccgcctcggtctcccaaagtgctaggattacaggcatgaaccaccgcgcccagccgggttttttttttttgagacggagtctcactctgtcgcccaggctggaatgtagtggcgagctctcggctcactgcaacctctgcctcctgggttctcctgcctcagcctcctgagtagccgggactacaggcgtgtgccaccatgcccagctaatttttgtatttttagtaaagatggggtttcactatgttggccaggctggtgtcaagctcttgacctcaagcgatccacctgcctcagcctcccaaagtgctgggattacaggcgtgagccactgcgcccagcctcatttttcatttttttttatttctttctttttttttttttttttttttttgagtcaggagtcaggggtctcactacgttgtcacccgggctggagatcaatggcgcaaccttggctcactgcagccttgacctcctgggctcaattgatcttcccacctcagcctcccaagtagttgggactgcaggtatgcatcacctagctaagttttgattttgtagaaacggggcctcgctatgtcatccaggctggtcttgaactcctgggctcaagcagtccacccactgtggcctcccaaagtgctgggattacaggtgtgagccaccatgcttggccgccgaccctagtttttttttgttttgttttgttttttgagatggagtcttgctctgtcgcccaggctggagtgcagtggcgcaatctcggctcactgcaagctccgcctcccgggttcatgccaatctcctgcctcagcctcctgagtagctgggactacaggcgcccgacaccacgcccggctaatttttttgtttttttttcagtagagacggggtttcactgtgttagccaggatggtctcaatctcctgacctcgtgatctgcccgccttggcctcccaaagtgctgggattacaagcgtgagccaccgtgcccagccttgttctttttttttttttttttttttttttgagacagtgtttcactcttggcacccaggctcccaggctggagtgcagtggcacaatctgagctcactgcaacctctgcctcccaggttcaagcgattctcctgtctcagcctcctgagtagctgggattacaggtgtgctccaatatgcctggctacatttttttgtatttttagtagggacggggttttgccatgttggccgggctggtctcaagctcctaacctcaggtgatccacctgcttcggtctcccaaagtgctgggattacaggtgtgagccactgcgcccaggctttttttttttttttttttttttgtgacagtcttgctctgtcgcccaggctggagtgcagtggcaccatcacagctcactgcagcattaaactcctgggctcaaatgatcctcccaccccagcctcccaactagctgggactacagttgcaaaccaccatacctggctaatttttgtttttttgattttgtttgttcatttgttttgtagcgatggggttttaccatatggctcagactggtctcaaacttctgggctcaagcagtcctccctcctcggcctcccgaagcgctgggattacaagtgtgagccattacacccagcccaaccctagctgcaataggcagagaataggtccctgacatctttgttctcccaacctcagttttacccgtctgtacaatgggttgtccatgagcctccacctggcccccttagcttgctccatctgcatgctggggttcaacataggtcctccacggctgggcatggtggctcacacctgtcatcccagcacttggggaggccgagagccgaggcgggcggatcagaggtcaggagatcgagaccatcctggccaacatggtgaaaccccatctttcctaaaaatacaaaaattagctgggcgtggtggtgggcatctgtaatcctagctactcgggaggctgaggcaggagaatcgcttgaacccgggaggtggaggttgcagtgggccgagattgcgccactgcactccagccttagcgttaagagcaagactccgtctcaaaaaaaaaaaaaaaaaaaatgatcctccacaaacttccgccttgatttgtgcctctcacatagtccaagtctgtttgctcatctgggcgatgggttcttgcaggtccctgataaacttctcctgggtcccccgggccttttgcgtgcctccggcggcgtgcacgggtccgcagcgaccccctgcccacctctgcccagcccctcccactctgcgggtctgttcagggcccctccgacctcagccttcggggccgggcagtgggtccgccctctgcgtccctggcgctcctgacctctcgcctctccggcctgcaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgaggtgaggtgtggtggcctgagcggagcggccagcggggagggtgtctgatggtggtgacacggggccaggagggcctgagggaggaggccagtgcgtgtgggtatgatgtggtggtctgagaggggaagtgggccttggagagtgcccaatgggggcgacacggggcacggagcatctgagggaggaggctggtgggtatagatgtgatgtggtggtctgagaggggaggcgagtctaggagaatatgtaaagtaggtgatatggcacaaggagagtctgagagaggaggccagtgcatatagatgtgatgtggtggtccaggcagggcagcaggcctgggagagcatctgatgggggtgacatggtgcaaggagggtctgagggaggaggctggtgcgtgtagatgtgatgtggtggtccaagcggggaggcgggcctgggagagcgtctgacgccgggtgacacggggcaaggagggtctgagggaagaagccagcatgtgtagatgtgatgtggtggtctgaggggggaggcaggcctaggagagcgtctaatgcaagtgatatggtgcaaggagcgtctgagggaggaggccagtgcatgcagggcccagggtggctgctgatgggatgtggaggtcagatggaggaggcaggcctagcagaggtctcaagtgagagatggtacaaggaggtttttttgacagaggaggcaggtgggctgtggcgctccaatggtagaggcaggatctcaccctcacgtctgagggaggaggcaggaaggcccttgaggtctcagggggatgagaatgtcctagatggtcttgggcacaacggacggccttgctgggagcaggggtgaggagaggagagggacaggccatcccagccctccgaggagagccaagagagtcctggcaccgctttctgtgaatgcttgttggttgattgactctcagaccatgccagcagaggcctgatgagcctggccctgccagaggggtgtttgccggtggtcaaatgcctgatgttgagaccagctagctctgtggggttgaggaaatccaaggcggcttcccagaggaggaggtgcagctgagctcagctctgcaggatggccaggccacagtgaacaaggagatgccccaggggtcctggcaggagcgtggagatgagaggcctgatgcctgtgcctctggtcccggtgctaagagcagggttggtcctgcagcttcttggctgcgtggccctcttggacttcagtttctcttgcctgccaaatggtggagatgatcagtctgtagctggatggggctatgggaggttccagaagatcatgcgtgtagccacgtgcgaggtgtcagctgcatcccaagacctgagtgggtgcacagcacacccctgccatgcccatccaggccgtgtctggagcacgcgtgaacccccacacacccaggggctgccagagcatgtgggatgggtgtacgccagacgcagacccacacaggtcaccagcccagccccagcccaggcagcactctatagaaacaggcagttgcacagcctgagagggaggggcatttgcccgaacaggaggaccctggggccagactgcccatgctccagacacagcccttcttttccccagctgtatggacacatcccttttctgtgcctcagtttcctccttggtgcaatgggagtaacagccatgccaccttctagagctggtgcaagggtgagacagggtcacgggctcccaggctctagggtgtgtggaaagacagcagggcagagttacccagtgtttttttttttttttttttcctggagacagggtctcgctctgtcacccacgctggagtgcagtggtgcaatctcggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggcaagagccactgcaccacaccagttacccagtcttttttttttttctttctttttttggagatggagtttcgccctgttccccgggctggagtccagtgacgcaatctcggctcactgcaatctccacctcccaggttcaagcgattctcctgcctttgcctccccagtagctgggcttacaggtgactgccaccacgcctggctaatttttgtatttttagtagagacggggtttcaccatgttggccaggctggtcttgaactcctgaactcaaacgatccactggcctcagcctccccaagtgcggggattacaggcgtgagccaccgcgcccggcagttacccagtcttgatcttgattctttgaccttgaccttagcatctttctcctcccccacccccactgatgagcaacaaacctgctggggttggctgtgagggggcactggggacggtgggggcagagaggtgggccgggtgactgcctgttgggagcaggggccaccgtggggacggaggttctcatcgtcacacagggccagacctctctgccaccacacatcttcctcgcccggggccccgcccccacctcctccgtgctgagctgatacaattttgaagcgagcttttctgctgcagtcagcacaacctctgggcgcctccccacccccaccctgcccctcccgcctctgctcagcaggcaggcctgtgccccaggtcaggttggcctctctgagtgaaggctgcaccctcccttgcccccagcctgcccccttcatccccaagggaatccctgcttcaattggccccagcaggccacaccctcccccaattggccccagcagggcacacccccccccaaccctcccacctgcccactgcgggtgctccagctcctcatgggggtaagagctgggcctggactccaaccccagctcagctgcccactggctgggtgatgtggggccagtcactcaccctctctgtgcttcatttccttgtctataaactggggggctcaaaactggttgccttgtgggaaatgtcaagtgcccagggtgagagctcagtaaaccacccacaaggcatcgtgaagaccaggcactaggcagggggctagggcccttggtggttatcgttactaacattatcctcttcgggattggtttgtttgtttgttattattggtttgggttttttgggggtttttttggttgttgttgtttttttttttttttttgagacagactcttgctctgtctcccaggctggagtgcaatgacgcaatcttggctcactgcaacctctgcctcccgggttcaagcaattctcctgcctcagtctcccgagtagctgggactacacatgcccaccaccacacccggctaatttttgtatttttaatacggacggggttttgcatgttggccaggctggtctccagctcctaacttcaggtgatccacccgcctcggcctcccaaagtgctgggattacaggcgtgagccactgcaactggccttgttttttgttttttgcagagatggggtatcactatgttgcccaggctactctcgaactcctgggctcaagtgatcctcccgccttggcctcccaaagtgccaggattacaggcgtgaccccctgcgcccggcccatcctcctcattctgattataatctcccactgccagacctttccttatgcattccctggacatagaatgtctttcccatatggaaaaccccaactccggctgggtgtggtggctcatgcctgtaatcccagcactttgggaggccaaggcaggtgactctcctgagctcaggcattcgagaccagcctgggcaaaatggcaaaaccccatctctaccaaatatacaaaaaattagccacctgcctggctgaaaattctttcccattctcacagctgccctgtgaggcaaggatcattgctgtatgccttttttttttttttttttttttttttgagatagggtctcactctgtcacccaggctggagtgcagtggcgcgatcttggcttactgcaacctctacttcctgggttcaagcgattctcatgcctcagcctcccgagtagctgagattacaggcgagcgccaccacacctggccaatttttgtatttttagtagagacgggctttcaccatgttggccagggtggtctggaactcatggcctcaagtgatccgccctcctcggcctcccaaagtgctgggatgacaggcgtgagccaccgcgcccggcctgttgtacgcattttacagaggaggaaacagaggctcagaggagggatttgacctgccgtggtcacacagccgagactgggccaggtgggatttggacccacaagcagcttctgcctctgccctgtccttgacacctgcctcatcctccattattgtcagaaggggatgggcggaagttgtggtgcgtgagggggcagtctgctggcacggtgtggtcaccttctggcagggttgtgtgagggccccacaggctgaggtcttatgtagggtccccaggctgtggctggcctccaggcctcagcgctgatcccagtggttgtcaccctgacagcaggaagactggccaccggcttccttttccgaaccgagagtccccttggctgtggagcgtcctggcccagccagagtgcagtgtctggctttcatcagccctgctgggcagctgaggccctgggatagagggagagggagggacgggcatcaggcatagggccttggctggcctcttggaggggtgcagggtggatggcggtggaggggcacctgccatggggctgaaaggagccaccacttgcaacgtcacaagtgagagaggaggccgggcacagtggctcatacctgcaatcccagcacttcgggaggccgaggcaggcggatcacctgaggtcaggagtttgaggccagcctggccaacatggtgaaaccccatctctactaaaaatacaaaaattagccgggcgtggtggcgggcgtctgtagtaccagctactcgggaggctgaggcaggagaatcgctggaacccgggaggttgcagtgagccaagatcgcgacactgcactccagcctgagcgacagagtgagactctgtctcaaaaaataaaaattaaaattaataagaagagggtgtcagggaactgcaggaaaataaagcagggagggacatggaggggggctgggggccactctggatggggagggcttctctgaggaggcgtctttgaggtgaggcttgaagggggtgagggagtctggagaggctgggtggagggagcagtgagggggttatagccagtgcgaaggcctggagcccaggagcagcacatggagctggctgggatgttcagggggtagtgagtggcgagggccgtcctgtggccttccagtgagggtgaccagccgggggtggggcgggagagggtgacccgggtgctctccgacctgccacgtgctggggaaggagcctgcaggaaccagggcccagagagggaagctgtctgcccgcccagggcctaaacccagccaggcctccccgccccctctggcagcccaagaaatctgaggcgcgggcgggcaccgtgccagggctgggcgggggaggggctgccaggcccgcccgtcccagcagctgccagcccgccccgagccgccagcccagatggtgcccatctgctgacgccgccatgggccagcctcctgttcccgccttgcgtcgtgccaagctcctgcagtccagcgccgggaatggcgcggtgggcagagcccggcccgggaagctcatagcacgccagagaggctgccccgggtgccctggagagggtggcaggagaaacatgggagggggagttccccagcgcttcctggatggaattggggagcaaggaccccaacagcgataatgatggcggcaaacacacatggcgtgccctctgtgtgccaggctccgaggccaccgctcaccctaactggtttaattctctcccccatccaagcaggaagggactttggccttctctcgtgttctagtggaggaagcagagacccagaggtttggacaagagtcacttgtccaaggtcacaaagctcctcaggggcagagccggaatgagaatccagaacccctttgaaaaagggattgaggccaggcgaggtggctcctgcctgtaatcccaacactttgggaggctgaggcaggaggatcacttgaggccaggagttcgagaccagcctgggcaacatagcacgaccatgcccccccccaacaaaatttttaaaaatgagccaggtgtggtggtgtgtacctgtagtcccagctactcgggaggctgaggcaggaggatggcttgagcccaggagttggaggttgcagtgagctgtgatcccaccactgcactccagcctgggtgacaaggcaagaccttatctctaaaaaccgttttttttaaggggtgattgaggccaggtgtggtggctcacacatgtaatcccagctacacaggaggctgaggcaggagagtcgcttgaacctaggaggcggaggttgcagcgagctgagctcatgccactgcactccagcctgggcgacagagtgagaccctgtctccaataaaagggaggtggtattgaaaccccttaaacctcttttcaaaaacaaactaaaagtgccctttgaggttatctagtggaagccacaccctctgagtcatacagatcatacagtgcaggccgtgcacactcagggagtaaatgaatgaatgaatgaatgaatgaggtgaaccctatggaaggggaccaagcctggggccagggtgtccataaagctcaccctgagcttgatggcaggagaaagggtctcaacctgggagtgagggacctgggtcagccacagtgctgccctggcttgctgtgtggctttgagaaaagtcctgccctctctggtctggggttgaggggagtggagggtgggaaggggcggccttgtgggccacagacaggagcaaggcgggtcttcactgaaagcctcccgtcctcttctgcctttattgatcttcatcccggttgtgggtgctgcactggggagacaggccatgagctcgggtgacggtgcctgtttatttgtatggtggacagaatttgtgttcctgtgtgctccaggcagtgtggggcgcattcttctctttgagccttagtttttgcctctgtagaatggggagaatcagagctgtgcccattgcattaaagattggagtcagtggtctctgagaagcatacaggaggcactcaataaatgctcacttccggccgggcgcagtggctcacacctgtaatcccagcactctgggaggcccaggcgggtggatcacctgaggtcgggagttcgagaccagcctgaccaacatggagaaaccccatctctactaaaaataccaaaaattagccaggcgtggtggtgcatgcctgtaatcccagctagtcaggaggctaaggcaggagaattgcttgagcccgggagaaggaggttgcggtgaaccgagattgcgccattgcgctccagcctgggcaacaagagtgaaactctgtcccaaaaacaaaacaaacaaacaaaaagaatgctcatttcctccctggattctctccccaaccccaggagggaaggagggaggtcccagtgccgccgtgaaaccctacacctccttttcccaacccagtgagccagtgggggcaccgtgacccaggagtggctgtcaccagaagctggaccaagtcaccctttccaggtgtctggacagcagaggggtgaggggttcctggcagcagcagcctgttatcccccagggctgggcagccaggtgtgccagccgtctgtctgtgcagagaaggtggctgccgggcgtgagtcgcagacgccagctgatggtgtatttatagcaacggcaggagtccgcggggcatacgtcagtggtaaagagggacgggcaggtgggggtccagctcccacagcagacaagagcccaccaggactggccagggagctgaacagagtgtcagggagaatgaggggcatgttgtgcagccgggaggcccaggatcacacccctctgctctggaactgcgtgatgtttgacaagtgacattgcagctgtgggcctcagtttcctcccccatcaaatggggatgataataatcctgcccacctaatagggctgcataggatccaattagtgcatgaaaagcatgaggacagggcctggtatacagtaagcactcaaaagtgatttgttgcctaaaaaagggagggaatcccaacatgggccacaatgtggatgcatcttgaggatgtcacactcagtaaaataagccagacacagaaggacaaatcctgtgtgattccactcctaggaggtccatagagtcgccagattcacagagacagaaagtaggatggggggtgccaggggctggggagggggctggggagagaatgtttcatggggacggggtttcagtttgggaagatgagaaggttctggagaggatggtggtaatggttgtacaaccctatgaatacgcttaatgctgggttaatgccactgaacttagaaatggttaaaagagaggcaggaggattgcttaaggccaggagttcgagaccagcctgggcaacacagcgagacctcatctgtacaaaaaatttaaaaattatctgggtgtggttgcacgcacttgtgttcccatctactcaggaggctgaggcaggaggatcgcttgagcccaggagtttgaggctgcaatgagctatgatcacaccactgcactccagcctgggcgacagagcaagacttgtctcaaaaccagaaccacccccaccaaaaaatggtaaatttatgttatctagattttaccacaatctaaaaatgtagttctggttgtgaataatgataataacaagtaataatattatatctatggccggctgtggtggcttacgcctgtaatctcagcactttgggaggctgaggcgggaagatgacttgaggtcaagaattcgagaccagcccagccaacatggtaaaaccctgtctctaataaaaatacaaaaattagccagtcgtaggccaggcgcggtggctcacacctgtaatcccagcactttgggaggccgaggcaggcagaccacttgaggtcaagagtttgagaccagcctggccaatatggcaaaaccccgtctctactaaaaatacaaaaattagccaggcatggtggcgcgtgcctgtaatcccagctacttgggaggctgaggcaggagaatcacttgaacccgggaggcggaggttgcggtgagctgagattgcaccactgccctccagcctgggcaacagagtgagactccgtttcaaaaaaaaatgttatatatgtaacaatgtaataattagtaatatgtcatatataatcatggaacaataaataagaaaaatagtgtctgcggtgacagcacagtagttattattgtcgttatcatgatcgtcatcactgtggttctcgtccagctctgccctgcagacagctgtgtaaccctgggtgagtttcttgccagctctgtgctttactgcctcatctgtgaattgagcatagggggtgcctagcaatttaaatgagataatagctcttttttttttttttttttttttgagatggagtcttgctctgtctcccaggcaggagtgcagtggtgtgatcgtggctcactgcaacctccacctcccgggttcaagtgattctcctgcctcaacctcccgaatagctgggattacaagctcatgtcaccacacccggctaattgtggtatttttagtagagcgggggtttcactatgttggccaggctggtctcgaacttctgacctcaggtgatctacctgccttggcctcccaaagtgctgggactacaggcgtgagccaccgcacccggcctaaatgagataatatctatgaaaaaactaaccctttgcatgtgatgagtgctgggaactggtaggctctttgaggagtaggtcctcccaccaccccgcagacgcccctacccagcagaatgctggtttctgcatgaatgcatttgtgtggggactcccgagacagcccctgagggagccctcattcacccgggtggggcccggccctcccagagccagtgggagggggaggcgccttgttgcacctgtgatgccccccgttatggctgggctgcagttgtcaccctggccctgtgcctgggaagccaaggggaggctgagggcagctagggacagctctgtgcccacggccccctccagccagctgccaggccagccccctccctccagctgggcgagggcaggaagtcacagatggtcagggttggtgaggggtgaagcagagggcatttggggacaccggatgtctcgtccagatggggaaactgaggcccggagaggggcgaggcattgccccgagttgcccaggaagggccttggctcttgtcccttctaagtcccatctttatttttattttttattttttggagacggagttttgccctgtcgcccaggctggagtacagtggcgcgatctcggctcgctgcaacctccgcctcctgagttcaagcaattctcccgcctcagcctcccgagtagctgggattacaggtgcccgccaccacacccagctaatttttgtatttttagtagagatggagttttaccatgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagggggttctgaggggaggaagacgcgagaatctcaacgctgaagtggtttctagattctccagggcatgagtcctgaaatccccaaggcctgagttctagaatttcttccactggggccctgaccacacaggtgattctagaattctcctaggtgagttccagacccaggggtccaggagaaatagaatgttggctgggcgtggtggctcacacctgtaatcccagcactttgggagaccgaggagggcagatcacttgaggtcaggatttcaagaccagcctgaccaacatgatgaaacccggtctctactaaaaatacaaaaatgagccgggcgtggtggcgcgaacctgtaatcccagctactctcaggaggctgagacaggagaatcgcttaaacccaggaggcagaggctacagtgagctgggatcgtgccactgcactccagcctgggcaacagagtgagactctgtctcaaaaaaaaaaaaaaaaaaaaagagttccaaccacacatataatttaacatttttctggtcctcacacttaagaatgtaaatttaagtatactggggaaattaattttaacattattttaagtaatgttaattttttttttccttgagacagagtctcgctctgtcgcccaggctggagtgcagcggtgcaatctcggctcactgcaacctccacctcctgggttcaagcagttctcctgcctcagcctcccgagtagctgcctcagcttcccgagtagtaacattaaaatgtttaattttaacattactttatttaacccagggcatctggaatgatactattgcaatccataaacaacaggaaaaattattggtctattggtcgggtgcagtggctcacgcctggaatcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtattttatgatcttttccccacccaccccccacccgcttacactaagtctgaaatttggacagaccacatttcaagcactggatgtcacacgtggccaggggctgctgtattgggcaggccgtgctaagacatctgagttccagagcaggggttcccgacccccgggccacagacgggttccgtgcctgggaggaacctggccactcagcaggagttgagcttagggcaagtgaccattctcacctgagctccacctcccgtcagatcagcgggcggctctgggtgcccctacgagcatgaaccccatggtgaactgaacataggagggatccaggttgcgtgctccttaggagaatctgactaatgtctaatgtctagtttcatcccagaaccatctccccactcaccccgtccctggaaaaattgtcttccatgaaatcggtccctggggccaagaaggttggaggctgctgttccagagaattcggaagcagatctccagtctcccaagttgggttctcgaaaacgtgagggcaggttctagaccttccaaactggttgcttgaaaatccaaggaggctgggcgcggtggctcacacctgtcatcccagcactttgggaagccgagacgggcggatctcccgaggtcaggagttcgagaccagcctggccaacgtggtgaaaccccatctctactaaaaatacaaaaatcagccaggtgtggtggtgcacacctgtaatcccagctactggggaggctgaggcaggagaatcacttcaatccgggaggcagaggctgcagtcagcagagatcgcaccactgtactccagcctgggcaacagagtgagaatctaactcttttgcccagactggagttcagtggtgcaatcacagctcactgcagccttcaactcccaggttcaagtgatcctcccaccttagcctcctaagtcgctggggctgggattacaggcgcataccaccatggttgattttttttttttttttttagtagagatgaggtctcactatgttgcccaggctggagtgctgtggtggactcatagctcactgcagcctcaatctctcaggctcaagggatcctcctgcttcagcctcccaggtagctggcagtataggcgtgcaccactacgcctggctgattttttatttttatttatttatttatttactttttgagacggagtcttgctttgtcacccaggctggagtgcagtggcgcaatcttggctcactgcaacctccacctcccgggttcaagcgattctcctgcctcagcctcccgagtacctgggattacaggcgcgtgccaccacaccggctaatttttgtatttttagtagagatgggatttctccatgttggccaggctggtcttgaactcctgacctcgggtcccaaagtgctgggatgacaggcatgaactaccatgcccggccttatttttatttttcgtagacaggaggtctcactatgtggcccatgctgggatttcaggctctttgagctttcttccatattggttagggctggagcaggactccactgtggcgggaggtatttgggcgcaaggagagcagttgtgaggactggtggtgacccccagttactgtctgttgtgctttggatgctgggcacgggaagcctggctgtaagtgtgtgtttccgggccgggcgcggcggctcacgcctataatcccagcactttgggaggctgaggtatgcggatcacgaggtgaggagatccagaccatcctggctaacgtggtgaaaccccgtctctactaaaaatatgaaaatattagccaggcgtggtggtgggcgcctgtagtcccagctactcgggaggctgagagaggagaatggtgtggacctgggaggcggagcttgcagtgagctgagatcgtgccactgcactccagccggggcaacagagtgagactccgtctcaaaaaaaaaaaaaaaaaaaagtgtgtgtttccaagaggctgttatggggcctcgggcacaccctcactgggtctggatcccagcctgtctaccaccaggcgtcccttctggtgaacagagctatgtgagaacttccaacagggacaccacggccgctcgtagcccagagcttgcagagctttgttcaaaggcaatggcccagggccgagcacggcggctcacacctgtaatcccagcacttgcagaggccaaggtgggtggatcacctgagatcaggagttcgagaccagtctggccaacatggcaaaaccctatctctactaaacctacaaaaattagctgggtgtggtggcacatgcttgtagtctcagctactcgggaggctgaggcaggagaatcgcttgaacccaggaggcagaggttgcggtgagctgagatcgcgccattgcactccagcctggtgacagagtgagactccatctcaaacaaacaaacaaacaaaaaagcagtggccatcatgatcggttgtgtcatctagtgggaggcaggggtgtgtctgcatgcgtgtctggggtgcattgtggggggattgcaggcgtattgagggcttaccaagtgcctggctcatctgagccctcaggaaaccacattgttggcagctacctcaccgtctcacaaccacccgctgaggttggaatgatcattaacagcatttaacagatggggaaactgaggcctagagaggcaaagtcactggcctaaggtcacatagctaaggagcacagtcaggatttaaatccaagcctgggagatcccaggacccacagtgggcaccacataaaggggctgtttggggtatggcagggactgccctggaacgttccggatcctgcctttgggcctacagggctttggtgccggtgagcaggccgcaggttcagctggctcaaggagcagcttcagggctgcagccaggctgggggctgggcaggtctcaaacccctggacctggggaatcagggaggtgtgagctgcatctgaggtcgggtgtctctgtgactctgtctctgtctctctacctctgattctccccaggctgccttgtctcagtccctgtctattcccaccccacctcgctctctctcccggccttgcgagtctcctcccagccccccatcccacccagtgggctgcccggaggtggcggcaacggggcagctgaatgggcctcttgttcctggccacacccgccccttggggtcaccctgggacatgcccaggcagcgtggctaccttaaagggccagtgctcagaaagaatgtgagcgggggaggctgcgtccactcccaaatcccacaccctccccaaggtggaccactcatgtgtctgacgggggtggggagctgtgtacctacacaccctcgtggcttgggggaggcctgtctggagcaggagatgtgatagggtttgggtttgaccttggataaatcccttcatctctctgtgcctcagtttccccatctagatcagggggctccttggtgccacccctgtgggttgctgggcagatggcatattatccaggattttgcacacagttgacactcttccggcgcccactgtgcattgatagagcacctgctgtttcagcccagcattcatccgccgtgcagacttggcaattccttcttcaccttgctccgtgcctcagtttccccaaatgcagaatgaggcgatggctgtcttagcttcacagagagctacgcaaggattgagtcggttcgtggaattagagggtattagggagaagggcctgaaacactgccaagtgtcacctccactggcgcacttattgagcgccagctgcataccaggccttgctgaggaagcctcactgcagaggttgcagtgagctgagaggcaaaggccacccagcctggatctcactctggtgtcatcgcctcctccctctgctcagggttgtgcagcttcaggctgctcccctgccctctctgggcctcagtttcaccttcagagcaacgggaacagccccatcctttcacacactggaaaccatcaccttcttctgcctgggagggggttgtgctgtctctgggaatcccaggcatcccccaggcaggagtcaacccagaggccctcggacccgggctgtaccctgtgacagctccgggtggctacgacgctcccgtgctccaggccagccccacagacagcccgggacaggttgctgccggatggacaagcctgtgcctcgctgccttatgtaaccagtttatgcaagggcagccggcccgcttacataaggggaggccgggccagcgcccagctggggagggggaggctcttaaagggaccggcgtcccccgcggctccctccacgggcactggtgcgaattcataggcgagctgcggactccgccctcagcaaggccgccattaatgtcgttatgattatttttgtggatgttgtttatcatcactatattctttccccagggcgggggttcagctgagcggaggaccacgcccagtgcttgggcagaggcttgggctgtgacgctggctctgggtgtcacctggttaagtccctgtctctgagcctcagcctccccttctgcacagtggggcaatgcaggaagacgtgaggtcctggagggtcctggccctgctgcctgttcactgtgtggcctcaggcaggtggcatcccctctctgggcctcagtttccccatctataaaatagcgcctgctctgtggggttgctgagggagagtcaataagacatattaagagtttacatgcccgccaggcatggtggctcacacctgtaatcccagcgctttgagaggctgagacgggaggatcacttgaggccaggagttcaagaccagcctgggcaacatagtgagatgcccatctctacaaaaaataaaacttagccaggcatggtgatgtgtgcctgtagccccagccactcgagaggtcgcggcaggaggattgctcaagtctgggaggttgaggctgcagtgagctgtgattgggccactgcactccagcctgggtgacagagcaacaccctgtctcaaaaaataaaaataggccaggcatggtggctcatgcctataatcccagcactttgggaagccgaggaagacagatcacttgagatcaagagttccagaccagcctggccaacaaggggaaaccccgtctctactaaaaatacaaaaattagctgggcgtgtggtgggagcctgtaatcccagctactggggaggctgaggcagaagaatcacttgaacctgggaggcggagattgtagtgagccgagatcgtgccactgcactctagcctgggtgacagagcaagactccatctcaaaaaataaataagtaaataaaaataaaaataggctgggcacagtgactcacacctctaatcccagccctttgggaggctgaggcgggaggatcgcttgagcccaggagtttgagaccagcctgggcaacatagcaaatctctgtctcaaaaatttttgaaaacaaaagagtttaggacagcacggagcacagacactgtcagcactcatccagtggaaccactttgcagccaataaatatttagtaagctcctactgtatgccaggcactgctccaggcgctgggatactgcagtgaacaggacagataaaaattcggccctggccaggcacggtggctcacacctgtaatcccagcactttgggaggctgaggtgggcggatcatgaggtcaggagatcgagaccatcctggctaacatggtgaaaccccgtctctactaaaaatacaaaaaaaattagccaggcgtgatggcaggtgcctgttgtcccagatcctcaggaggctgaggcaggagaatggtgtgaacctgggaggcggagcttgcagtgagccgagatcacgccactgcactccagcctgggtgacagagtgagactctgtctcagaaaaaaaaaaattctgccctcgtggaactcacagtttggttcaggcgatgggcaaagaacaagaaataaatgtcagtttaggcttagtgcggtggctcacgcctgtcatcccagcactgtggggggccgaggcgggcagatcacctgaggtcaggagttcaagaccagcctggccaacatggtgaaaccccgttcctactaaaaatacaaaacattagccaggcatagcggtatgcgcctgtaatccagccactggcaggggctgaggcaggagaatcgcttgaacccggaaggcggaggttgcagtgagccgagattgtaccactacactccagctggggccacagagcgagactccgtctcaaaaaataataataataaaaataaaaagaaataaatgtcagtttagcgataaggactatcaagaaaaataaagaaggccaaaggaaaagaggctgatgggctgtgctggggaggtccctgaaaggctgtctgaggacctgacatttgagctgagacctgagaagtgaggaggaaccagttatatgaagaactgggggaaggcgttccaggcagagggcacagcccgtgcaaaggccctgcggcaggacacacctggcactttggaggaacagtgaggaggcctgtgtggctgcagcagagtgaggagaggaagagaaggaggaggggagggcagtttgtgcaaggcctggtgggcagtaggaaggacttgggctttgaccccaaggcaggtgggagccatagagggctatgggcagaggagggaccagccctgactcaggtgctcacaggcaccctctgcctgctgcagggaggacagactgtggggggtgagggcaggagctggggaccagggcagagtggaccgccctggtgcaagcaggcggtagcagggacagaggcagaggagggggcagaatccaggtcaactccgacggtgtgaggattcagttgctcacctgggtcgtttataccttatctgaggctggcccttgctctccttgccccgtctcctgcctgcaagccgcacctgcctgggcacatgcagggaagggagcggcgcagcactgggcacgcctgggagctctcctgcaatcaggactttgttagcgggcaagctgggatatgggtcctggtgcccgggaggcccgtggggctctgggctcctgccagggtcccagccctaacccaggtacgccacccacatggcagggttattctctttttttttctctttttttagacagagtctcgctctgtcacccaggctggagtgcagtggtgcgatctcagctcactacaacctctgcctcacaggtttaagagattctcctgcctcagcctcctgagtagctgggactacaagtgtgcaccacctcacccagctaatttttgtgtttttagtagagacggagttgcaccatgttggccaggctggtctcaaactcctgaactcaattgatccaaccgcctcgacctcccaaagttctaggattacaggtgtgaaccaccgtacccagcctattctcatttattttctttcttatttttttttcttttttttgagacgaagtctcactctgtcacccaggctgaagtgcagtggcacgatctcagctgactgcaacctccgcctccagggttcaagcaattctcctgcctcagcctcccaagtagctgggactacaggcatgtgccactatagccagctaatttttgtatttttagtagagatggggctttgtcatgttgacgaccaggcaagtctcgaatgcctgacctcaggtgatccacccagcctcagcctcccacagtgctgggattacaggctggagccactgcgcccagacggtccttccttttcatgcctcctccttccactcccccatgtaccatgtctccttgtctctctttttctctctgctcatccctccctctcaactttctttctacaaatatttattgagcacctagtctgtatcaggccttattctagccactgagggcacaacagagatctagacagacaaagcctctgccctcaaggaggtgacattccactggggagatgagcaaacacccgtgcagtcactaagcaactaagcaaatccataggcaatcactaacttcctctgaaggaaagaaaacagaaggctgagattgagggtagccagaggctgcttgaggtgaaggggctcagcgtagacctctctgagaagggagcatttgagctgagaccaggagagatctcaagagagagcaagcagttagctgtttagacagagggaacagaatgtgcaaaggccctgaggcaggactgggccaggtgcattggaggaacagcgaggaggcccctgtggctggagcagagtgagtgagggggagagagggaagaggggagggcagaaagcggacaggacaggttgtgcagggcctgtggtcctagtcctccactttgactactcccccaaatctcttaatgttcctcacattcctttccctgacaagcatttattttgcacctgctgtataccagatcctatcaggagaatcccaaatattcatgcaacaagttcatattgggtgcctactgtgtgccaggctctgctggaataatcacactcatttggctgcaggcatttattgagtgccagctgtgtaaaagcatttatcgagcaccacctgtgtagcaggctctggggagagaggccacatgaaagcttgggaaggagaaagtttccttctaccccctttcaggtttgtgccctctggtttccagccccctcccacattcaaggcaacatttaaacctctgggttcaagttccgttgtccaactgcgtggccgtgagatctgcggcaagccccttcctctctcggatcttccgtttccccctttgtaaagcagaacactccacaatctgatgtgtttacaacttgacatctactttttgcagcaagggaaactgaggcacagagcagggcggagatgtgtctacctctccctccccaagcaagactggcatggagtctattctcctgaccccacgccaaagccagggcgtttggtattttgttttttcttggaggcccagagaggggcagggcttgcctgaagccacacagcaccgggcaggcctcggaattgcggagagccctcccctgggcgcctgcccgggctcccgcgccttcctcctgcctcctttggctgggccgccagccttgcctcccgtcctccggactccccgcgggctgcccagttggagacgcgccccaagaaatatcagaaggaaggggaagccgggaggggcctccgcctcctcccgccaccccccgccgcgcccggctgcccccacccggtgcccgacattggcagagagtgtcctcgggcgcttccgactggccctgcctgcttcgtgtggccactgatcccttccggagcctctccatggggacgcccgtgtgtgcgctcagccagtggcacatgtggctcccggggctcccttctccacccccccagcccctggcctgcccctttccccccatcccttcccgaacctctccatggggacgcgtgcgtgtgcgttcagcccgtgggcacatgtggctcccagggctccccccgaggcctgcccttctcccccccccgtcacagccgccgagtcaggcctgccaggaaggtgttgggggtgggggtgtggggaggcctcagcttggctgctgggaagccaagaatttgctccaaatgtaaacagcgagttattttcagtccactcccccccaccccgggtggcgttgacacatttgacattggcgggaccgggagggggtgggggtgagggtgtgcgtgcgggtatttttaaccttgctcctcacatccctggagtggctggtgccgagtggcagataatggggagggggcgcggaggcgtggggagccctgggtggccgtgcgcgggtgggcgcttggcaaggccgccctgctgttggcaccacgtgtttaacccctcagaggctgcagaggggctgggggaggcggcccagggcccagtggtgccccagaggctcccttgtcaccttctcctggtgtccccccacccccaccccacccaggagggcagggccgggtgcccgaggccggtgccagcctgcgccgcccagacctacaaaatggccgccaaggccggagaaacatctggaacaggggaagggagaggcgagaaaatggccgccagagggatgatgtcatgggcggcgtggcctcccagagcgtccccagcacggggcgagtccctacgcgcaggcctccgagcaggggccctgcggcctccagggacctccagacccgctgcccaggccggacacccacaaagagtgacaccggggtccccaggggtccccagaggcgggcccgagacctgggggagggcgaggccagcactgggcctccagtcccaacagcccgatgctggggacggttccggggcggtggtggccgctgacctgacccgcaggacaccgaggcgtccaccagcgcccgggagggcccggagccaggccatggagccggcgggggccgggtggaaagaaaaaagaaacttttctttgaaagtgattccgaagcaggttggctccggcccaggcggcccggcggcaggggagagggagatggaaagtatgggccagacttaaggaacgcaggaaggacgaggccggggaggcccgggatggaggccagcgtcctggaggtcaccccgtccacgcctctgcctctcgggcccccccaggtcacatccagattttcctccctgtccctggggcgggcggggagtgcggagaacatctatgggcttgtgttttttcctcttttgatttgtccagacaggcgatggacaagggctgggcaggggttttaggtcatctgcactgtcaggatgtggaggctcagagagggagagtgcttttagtgaggtcacacagcactggcaaaactgacagctgcttccctccttagagcatcttggggaggaggaagttctctatggaggatcagggtccgtactggaattcctttctatttttatttaatttaatttatttatttatttatttatttttgagatggagtttcactcttgttgcctaggctggagtgcaatggcacgatctcggctcactgcaacctccacctcctgagttcaagcgattctcctgtctcagcctcttgagtaactgggattacaggtgcctgccactacacccagctaatttttttgtatttttagtagagacaggggtctcaccatgttggccaggctggtctcgaactcctgacctcaggtgatctgcctgccttggcctcccaaagtgctgggattatacgtgtgagccaccgcgcccggcccctttttctttttctttcttcctttctttttttgaaacagagtcctcctgctctgtcacccaggctggagtgcagtgacttgatcatggcttactgtagcctcaaccttctgggctcaagcaatcctctcacttcagcctcctgagtagctgggaccacaggcatgtaccaccatgcccagctaaatttgggttttgtttgtttgtttgagacagagtctcactctgttgcccaggctggagtgcaatggcacgattttggctcactgcaacctccacctcccaggttcaagcgattctcctgcctcagccttccaagtagctgggattacaggcacccgccacgatgccctgctaattttttgtgtttttagtagagatggggttttgccatgttgcccaggctggtctcgaacttctgacctcaagtgatccgcctgccttggcctcccatagtgctgggattacaggcatgagccaccgtgccctgcctatttttttttttttgtagaaatagggtctcactatgttgctcaagctggtctcgaacttctgacctcaagtgatcctcttgccttggcttcccaaagtgttgggattacagcgtgagccactgtgtccagccaatgtctgtgtgtttttcactgctctgtccccagtacctaggacagggcatggtacacagtaggcgctcaagacgtgtgttggataaaagcatcacagttttctcctgaggctggggttggcacagatgctggcacaggaagggggcagaggctcaggaaatgcaaagtaggttgcaacgtaactggacacacacgggaaccctgtggtcacatttttcaggagggatgtgaggaggcgaaaactcaaacttccctcacttcaagtgcagattctgtgccgggagctgtggacgataaaccacatttgaacagaagcctgaataaagcgagagagtgagccaggcaggcatttgcagggacggtgttccaagcagtgtgcacagcccgtgcaaaggccctgaggcaggaccgtgcctggtgcattggtggaacagccaggaggcctgtgtggctggagcagagtgagcgagggggagagagggacgaggggaggaggggagggagggggcagaggcgggctgtgcagggccttgagcgccatggggagatggggagaacttggacttttagatatttggttttctgttttttgttttttgtttttgaggtggagtctcgctctgtcgcccaggctggagtgcagtggtgcgatctcggctcactgcaagctctgcctcccgggttcacgccattctcctgcctcagcctcccgagtagctgggactacaggcgcccgccaccacgcccggctatagttttgtatttttagtagagacggggtttcactgtgttagccaggatggtctcgatctcctgacctcgtgatccacccgcctcggcctcccaaagtgctgggattacaggcgtgagccaccgcgcccggcccaattgtttggttttgtttttgctttgttgttgttgtttttgagatggagtctcgctctgtcacccaggctggagtcactggtgcaatcttggttcaccgtgccctctgcctcccgggttcgagcaattctcctgcctcagcctcctgagcatctgggattacaggcatgcaccaccacgcctggctaatttttgtgtttttagcagagacgaggtttccgccatgttggtcaggctgagctggaactcctgaccttgtgatctgctcgccttggcctcccaaagtgctgggattacagacgtgagccaccgcgcccgggtgaactttcacatatttgtagacccagacacagtccagggtgctggggactagaacaaacgtttgcagaaagggctggggagggtgttccagagaaggagatgtcagagctgggctgcaaagtatggctggaggtttcctaggagggagaggggcagggaagacggcacagcaggagctcagaggactcaggcccaggtcactcgtatattccattgccttccaggacagagaaagttgaaccttcgccgggtaatgtttaaaaatggccggtgacacccagtagctgggaattccagggcctggctttggttctctctttagctggctgaggttgggaggcggacgtggcagccggcagagccagcaacatttggaagccggctaacgttggaaaatcaaccaggcgagctcacggtggcggccgatgctggaaacctgggctccgtgaggtccagcagatgccctgctggggcccaagtggacattctaggccttctgacagcccgccgggtttttaaataagtgtgattatggtttcagcaagtcctgtccttcctacagccaaaagatcaattcaatatggccactccgtgcaatgctgggccacccctgctgggccagggtgttgtgttgaagccaagattcccaacacctgagagtccagaagtttctttaaaaattgctttaactgtggtgagacacacatcacacactttttttttcttgagacagggtttcactctgtcacccaggctggagtgcagtggcactgtcatagctcatcgcagcctcaaactcccaggctcaagcaatcctcgcacctcagcctcctgagcatctgggaccacacatgcagcacgcaccaccacacccagctaatttttattttattttattttatttttgagacggagtctcactctgtcgcgccaactcggctcactacaacctccgcctcctgggttcaagcagttctcctgcctcagcctcccgagtagctgggactataggcgaccgccaccacacctggctaatttttgtatttttagtagagacaaggtttcaccatgttgaccaggttggtctcgaactcctgaccttgtgatcccaaagtgctgggattataggcgtgagccaccgcccctggctgacacccggctaatttttaaaaatattttgtagagatggggtcttgctatgtggtccaggctggtctcgaactccttgcctcaagtgatcctcccacttcagcctcccaaagtgctggaattacaggtgtgagccactgtgcccggcccagagacttttgaaagtctaaaatggattgtatcatagctcacatcactcctcttcccactgcaggataaaacccaggcctctcactgcaacacacaaggccccgaatggtcccgctcccctctccgttcgttcctctttctcttgcccaccacgctgcagcctggggtctgtctctgcctttcacacatccaacttcattcctgccccgtggaccttgcccttgtcaccgaacctttgtggaacgctttcaccccagctctccacatggctgggctccttctcccgctggagagccaccgtcacatcctcagagaggttctgcctgagtcctccctccaacgccgcccccaaagccattctgccttccgccagtttcattgcctccgtagaacctagaaccgtgtgaaatgatctgaggcttcctccatgcactggttctgcccgtctccctccccacttccttctctgccatccccccaaggcctggcgagtagtaggtggtcagtaaacacctgttccgtgagtgccgggtgtgcgttgacctcccagtcaccaacggcggaagcttcagccagcggacgcagggagttgtcccttgcaaagggggtgggtgctcccgggcgggaagggtggggccagagcccacggcgatgcctttgtcatgagctaggatggactgaatttgggctcacagccacggacaggagagaacagtgtgtccgccccgtcagtgccatccagcgtgcgtggctgttgtgcatcatttgtttgcttgagcaaaggctacagggtccagtgacattcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaacatagcgagactgcgtctctactttttttttttcctgagacggagtctcgctcctttgcacaggctggagtgcagtggttcgatctcggctcactgcaagctccgcctcccgggttcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgtctctctgagaaggagctatttgaggaaagtcctgaatgaggggagagaatgagccatgtagatagctgagggaacagtgttccaggcagaggcgcagcccgtgcaaaggccctgaggcaggaccatgcctggtgtgttggaggaacagcgaggaggcccccgtggctagagcagagtgaggaaggggagacaggaaggaggggagggcagggaggggactgatcgggccatgcagggccttgtgggccacgggaagaaggtgggcttttccccgcaaagaaggtgggagctatggagggctgcgggcagaggaggggtaatgttcatttaactcctggagtttgacaaaatgctatcatcaaaacagactttatcacagaacctctagctatccccgtcccctccgtaagctcctctgagcatagcaacagaacgggaaggtaaggcagcgattggaaacgcccgcgttatagatgagcggagagccgctggaggttggaggctccgacagaggaggtgactggtccagagccacatggccaggttgtgctggggctggaactccatcgaacgcaggtttcagggtgcagcccttgtttccataagataccccaaaatcagacaagcctgggacttgccacctcttctttaaaaaccccagtgctgtttttgttgttttttttgagatagggtctccctctgttgcccaggctggagtgcagtggctcaatcatagctcacccactgcagccttgacctcctgggctcaagcagtcctcctgcctcagcctcttgagtagctgatactacaggtgtgcatcaccacagccaggtaacttttttttttaaagtagagatggggtggggtatcctgtattgcccaggcttgtctcaaactcctgagctcaagtaatcctccctccttgaccttccaaagtgcaggaattataggtgtgagccaccatgcccagccctccagtgctttttttttttttttttgagacggagtcttgctctgttgcccaggctagagtgcagtggcacgatctcggttcactgcaacctctgtctcccgggttcaagcaattctccttcctcagcctaccgagtagctgggactacaggcacacaccaccatgcccggctaatttttgtatttttagtagagaccaggtttcaccgtgtcggtcaggctggtctcgaactcctgacctccagtgatctgccctccttggcctctggggattacaggtgtgagccaccactcccggccctccagtgcattttaaaggctctgaaaagtcctacgttgtcctgaaaactcctcagtgatgctgaacctttttgacctgtgaaccccaggtttgggtaaagtctgctcacatccggcggcacacccataggaaacccccagcccggctgtgaggagtgtgaactttgattcaccaggtccttggcccagctttagtttctcccgtgtccgtgtttgcttgtgcaatcatgaatatatattgaccagcaccaggtgccacattgaacagtttgtccgcgccgtcagtgccatccggcatgcacggctgttgtacatcatgtctttgcactggactgagctcagctgcagaaagcagcacatttcagagggtgtctaccgggccaggagaaaacacacaaaccgccaacattttaaagcctgtaatcgacatcgtatacaattggaaaagatgttcatttatatgttttgtttttgttttcttaagacagggtctcagtctgtcacccaggctggaatgcagtggtgcgatcatagctcactgcagcctggagctcctgggctcagacgatccacccacctcagcccccagagtagctgggactgcaggcacaggccaccacgctgggctaatttttagatttttgtagagatggggtcttgctctgttgcccaggctggagtgcagtggtgtgatcttagctcactgcagactcaaactcctggattcaagccatccccacctcagcctcccaagtagctgcgactacaggatgtgccaccatgcccagctaatttatttttatttttatttttgctagagagagtgtctccttatgttgaccaggctggtcttgaactcctgacctcaagcaatcctcctgccaaggcaatcctctcaaaatgcagggattacaggtgtgagccactgtgcccagcctgttcatacgttttaaagagaggtgcagacaaaactgggttggtgcatccacatccctctctgtgtgatgctgggtaatttgcttaccctctctgggtatcctggagattgtcagccccagccaaggatggttaaaaggcattaaacaatacctaggacagagcctgacatctggagctcattaaaccatccgtacatgcagatgtcgttataattattatcaatgctattctgtcactccacaccctgactcccacctcagtggccccaggtgggggtgctctgaaatttctctggcctggctgagcgggaggggccggggttctgctggaataaagaacagaggaggaagccttgaaggatttgttctgtcccagctgtccccagtatcacagttagccacacggatggcagaagggacctttgacagtggacacaggggctggaagggcccagcctggggctcactgcaatctccgccttccagattcaaatgatcctcctacctcagccttccgagtagctgggattacaggtgtgtgccaccacacccggctaatttttgtatttttagtagagatggggtttcaccgtgttagccaggctggtcttgaactcccgacctcaggtgatctactcacctcagcctcctaaagtgctggaattacaggcatgagtcaccgtgcctggccttggggctttatctgactggctagagaatgggattcaaacaccaggaatcatcccaaaccgccaatgagaaggagccctggagtgaggggaaccgagacccctcctaaaaggatttacagggtgtcacagaatcaaaattacagcaaaggctcaactgtgagatgccagggtggctgatcattgattctagacccatcactaccagctggtgttctgtgagtttgaagccattgctgtctagctttgtgcctcagtttccccagctggcgattaccgtcccccatatggggacggtaatcacgtgtctgctgcagaggagttacaaagatttgtgaggcaatggaggcaacatttgcagccgaacctagtcaaaggaattactcactgcgcattaatttgttgttttttgagatggagtctcgctctgtctcccaggctggagtacaatggcgcgatcttggctcactgcagccatcccccgggttcaagcaattctcccgtctcagcctccggagcagctgggattacaggcacgcaccaccacgccaggctagtttttgtatttttagtagagacagggtttcgctatgttggccaggctggtctcaaactccaggcctcaggtgatcctcccacctcagcctcccaacctccctagcatttcaacgacctgaagtgaccctcttgatttattttctgacttgttcatttcctgtcacgttcccattagaacatcagtgcctcgagaggagggattcttgtctgtctctgttgccgctgtgtcccttgggcgtctggcatccgggtggctctctgcaatctgtttgctgagtgatcaaaggaaagaactaatggcaacatagtgcagctccaatgtacagatgaagaaatccaggctcagagatgtggaagtacttgcccagggccacacagccggaagcccgccaactcttttagtaaagggccagtgacactgtaaacattttaggcttttaggcaggtcacatgcagtctctgttgcctattttttcttttgtttacgaccctttaaaaatggaaaagacaggccgggcgcggtggctcacgattgtaatcccagcactttgggagtccgaggcggacggatcacgaggtcaagagttcgagaccagcctgaccaacatggcaaaaccctgtctctactaaaaatacaaaaattagctgggcgtggtggcacgtgcctgtagtcccagctactctggaggctgaggcaggagaatcacttgaacccgggaggtggaggttgcagtgagccgagatcacgtcaccgcactccagtctgggagacggggcgagactgcatctaaaataaaataaaataaaataaaataaaataaaataaaataaaataaaataaaataaggaaaagaccatacttagctgactgtgcaagaataggcaaccccttctagtttgctcatctaatgtcagaacccacgaactgattccaaaaccctccacagagaatctaaaatgctgcaaaccccgactctgtgatgctggggatctaaagtgcttagtttgtttttttgtttttttgttttttgtttttttgtttttgtgttttttgagacagaggctcgctctgtggcccaggctggagtgcaatggcatgatctcggctcactgtaacctctgcctcctgggttcaagcgattctcctgcctcaacctcccaagtagctgggattacaggtgcctgccgccacacccggctaatttttgtatttttggtagagacggggtttctccatgttggccaggctggtctggaaatgctgatctcatgtgatccaaccgcctcaggctcccaaagtgctaggattacaggtgtgagccaccgtgccctgccaagtgcttggttctttagtctggagtgcagtggtacgatctcggctcactgcagcctccacctgccaggttcaaacaattctcctgcctcagcctcctgagtagctaggactatgggtgcatgccagcacacccagctaattttttttttttggtacttttagtagagatggggtttcaccatattgtccaggctggtcccaaacccctgacctcaagtaatcctcctgcctcggcctcccagagtgctaggattacaggtgtgagctctactgcgcccggccaagtgcttggttctttctcgactcaatcctattttgttctacacaggtcaggtctgcctccactcccccaaccccatgccccatttcacccattggcctctgaagcccagagatgggcaggggtttgtctgagaccacacagcaagaggggcagcagaggaggatgggaacccagatctgcttccctcccaggctacacccctgtagccccccaacccctgcaaacttgttatttaagcctcctcattacaggggtttggagccgaggaagccctgctgccttttcgtaaatgctctccctagacagcaatctttgatggaggctctgggagaagttgttcagtgatgtgcatttgtcgagcacctactgtatacctggtgccagtatagggttgggtggaagggtcttgtccactcaacacccctttttctgccctattattgccttccctggccaggcgaggtgactgacacctgtaatcccagcactttggatggctgaggcaggaggagcgcttcagccctggagtttgagttcagcctggccaacatagtgagacctcatctctacaaaaaaatgtttgttaaaaattagccagatgtagggccacaagcctgtagccccggctacttgggaaaagaaggcaagagaatcacttgagcccaggaggtcgagcctgcagtgagctatgatgacaccactgtcctccatcccgggccacagagtgaggccctgtctcaaaaaaaaaaaaaaaatcaagaccatgattgcccccccataaagagcccttttaaacattttttccctaatcactctcctgtgaaattttaatagcataggtatattttatatacctatatatattaaaaatgtacctgtgccatcaaatatatataatatatattatacataggtatataaagtataactatatgtcatatagataggtatataaaatgtacctatatggcctgtaggtatataaaatatgccatataggtatataaaatatacttacgccattaaatatatatttaatatacaaatatatttgtttttttctatactgtaacaacatatgtctgtacattattattattattattattatttttgagacagagtttcactcttgttgcccaggctagaatgcaatggcgtgatctcggctcactgcaacctccgcctcccgggttcaagaagcaattttcctgcgtcagcctcctgagtagctgggattacaggcatgtgccaccgtgcccggctaattttgtatttttagtagagacggggtttctccatgttggtcaggctgctctcgaactcctgacctcaggtgatccaccgcctcggcctcccaaagcactgggattacaggcgtgagccaccgtgcccatcctacatttttttaaaaacacaaaattctggccagacatggtggctcacgcctgtaatcccagtgctttttttttttttttgagatggagtctcgctccgtcgcccaggctggagtgcagtggcgcgatctcggctcactgcaagctccgcctgccgggttcacgccattctcctgcctcagcctccggagcagctgggactacaggcgcccgccaccaggcccagctaattttttttgtatttttagtagagatggggtttcaccatgttagccaggatggtctcgatctcctgacctcgtgatccgcccgccttggcctcccaaagtgctgggattacaggcgtgtgccaccacgcctggcctaatcccagtgcttttggaggcctaggcaggagggtcacttgagcccaggagttagagaccggcctgggcaatatagtgagacccccatctcaaagcagaacaacagcagaacttctgagctagacagacaactttgctttgaatctgacaccagctttgggaaatacgctgtgcgcactgggccttggttgaccaaccttacaaattgagcagatttaatcagatggggtcaggaagtgctaattcagcacagtaaaaactcagcagatggaagctgcccactggggtctggggaatcttggggctgtggaagttagccagccttcgacattatgcactttgtacacatctgctcagaccgaaagaaggtccattttaaggctgggtgtgtactaagtaggtggaggaggaggaattatctgtgcctctttttcttttctttttttttttttttttttgagatggagtctcgctctgtcgcccaggctggagtgcagtggcgcaatctcggctcactgcaacctctgcctcccgggttcacgccattctcctgcctcagcctcccgagtagctgggactacaggcgcccgtcaccacgcccggctaatttttttttttttttgtatttttttttagtagagatggggtttcaccatgttagccaggatggtctcgatctcctgacctcatgatccgcccgcctcggcctgtcagagtgctgggattacaggcgtgatccaccgtgcccggccacctctggaagcagccagggccacacagtgcactagaatattcctcgctgatggcagaatattctgtgctgtccaacttggtcaccaccagccacgtgtggctctttggtgcttgaaatgtgatttgttcaactgagcaacttaaaatttaattttcttttctttttttttttttttttgagacatagtctcgctctgtcacccaagctggagtgcggtgactccatcataactcactgcaacctccacctcccaggcttaagcagtcctcccacctcagctccccgagtagctggaactacaggcatgccactacacccagctaacttttgtattttttgtagagacggggtctcgccatggtgcccagtctggtctggaactcctgggctcaagtgatcctcctgccttggctttccaaagtaccgagattacaggcatgtgccaccacgccccgcctaattttatttcagcgtagctaacttaaatgtaaaaagtcatatgtggctgtgacccttgtactgatggctgtagaacgtgaggagttttcaggagccaaatgatggaagaatggtcagcaggtggttgagaactattcccaggttttagagatgatttaaaatgagacggctggccgggcgtggtggctcacacctgtaatcccagcactttgggaggccgaggcaggaggatcacttgacgtcaggaattcaagaccggcctggctaacatggcaaaatcctgtctctactaaaaatgcaaaaattagccaggtgtggtggcaggagcctgtagtcccagctactcaggaggctgaggcagaagatttggttgaaaccaagagacggaagttgcagtgagccgagattgtgccactgcactccagcctgggcaacacggcaagattccatctaaataaataaatacataaatacataagatgaggcagccaaataaaaaggaaggagattctgaccaggctactcacatgggtgaaccttaaggacattaagctcaattgagaaaagccggacacagaaggacaaatactgcaagtccactcctaggaggtccctagagtcgtcagattcatagagacagaaagtaggttggcggggtcagggggtgtcggaggctggggaggggacggggagtgagtgtttcatggggacagagtttcagtttgggaagagtagaaagttctggagaggatggtggcgatggctgcatggccattggaatgtatttaatgtccctaaagctgtgcatggaaagttggttcaaatggtaaatattatgcatattttaccacaataagaaattaaattaaaaattaaaatgagatggcatagatttatagcatattatttttaaaactaaactaattttggccaggcatggtggtgctcacccatggttccaattactcgacagtctgaggtggggggattgctggagcccaggaggtccaggctgcagtgagccatgattgtgccactgcactgcagcctgggtgacagagcaagaccctgtctcaaaaacaaaattaggccgagcacagtggctcacacctgtaatcccagcactttgggaggctgaggcacgcggatcacttgaggtcagaagtttgagaccagcctggccaacttggtgaaaccccatctctactaaaaatacaaaaattagctgggctaattaaaattagattagaaaattagattacaggtggcacacacctgtaatctcagctacttaggaggctcaggcaggagaatcacttgaacccgggaggcagaggctgcagtgagctgagatcgcaccattgcactccagcctgggcgacacagcgatactctgttccaaaaaaaaaaaaaaatttaatttaattaaaaaacacataaattcctaggactataggaaaagaagaaaacttccttaacccaagaaagggaactacaaaaccccacagctaaccccgtacttagtggtgagaggctggatgttttctcccgagatcaggaacaagacaaggacaccactttccccatttctattgaacattgtactggaagttctgccagaccaataaggcaagaaaagaggctggacgtggtagctcacacctgtaatcccagcactttgagagaccaaagagagtggatcgcttgagcccaggagttccagaccagctagggcagcatcgcgaaaacccgtatctacaaataatacaaaaattagccagatgtggtggcgtgtacctggggccccagctacttgggaagctcagataggaggatggcttgagctcaggagttcaagactgcagtgagccgtgattgtgccaccttactccagcctaggtgacagagcaagatcctgtctcaaaaacgaagaagagaaagagatcagcctggctatcatggtgaaaccctatctctactaaaaatacaacaaaaattagctgggcgtgtgggcgtggtggcacgtgcctgtaatcccagctacttgggaggctgggaattgcttgagcccgggaggcggagattgcaatgagctggatcgtgccaccgcactccagtcctggcaacaagagaacaagagcgagattccatctcaaaaaaataaataaataaataaataaataaataaaagatacaaaataacaccatcaaagacagtaccaatagcgatattaatcaaatagcaatagtagtgaagctgccctctgcctggtgaagcactcactatggcagccatggttctgggagttttattaataattcattcatcacctttttttttttgagatggagtcactctgtcgcccagactagagtgcaattggcccgatctgggctcactgcaaaatccgcctcccgagttcaagagattctcctgcctcagcctcccaagtagctgggattacaggtgcccaccaccacgcccagctaatttttgtatttttagtggagacggggtttcaccatgtggggcagaatggtcttgaactcctgaccttaggtgatccacccacgttggcctcccatagtgctgggaatacaggcgtgagccaccgcgcccagccaatgtttcattcattaccatcttgtccctcataaacagcttccaagagggggtgctatagttgtgtccatttcacagatgagaagagtgaggcgcggatgcatccgaggccccgctccctggctgcccgattcgcaagctcatgctgggagccaccgtggggcctgacacttagtaggtgcccaagaaacattctcccttcccagggaaacacccggatgccagctgggcactgcggcctgctgagacgccagctgggcactgcagcctgctgagtctgtgtgggctctggttccggaagagggtcctgtgcccacggcctggcgcccggacggccggctgcccaggctgggtccttcccaacgtcatggccaccggtgcccagccttgagacagtccaaagggaactggccagctccgaggggccgctggcagccccagcctgggatcggctgcagggcttggggccgagctgggcacactcccctcggctgctgtccagcccagatggccacggccggggcagcctagctggaggaagggcttctctcgtctgctcctctgtttcctgacgaggaaactgaggcaccgggccctgctcctgtgctgttcatggcatccttggtcttggcaatcagtgggtgctggacacacggtgtgtgcatagccattagcacggcgccaggctaactccagaggctccgtgcgctaggaaatatcattgctttgatcattctcacagcaaccctgagaatggtctccatttatttttttaaaacaaggtcttgctctgtcactcaggctggagtgcagtggcatgatcacagctcactgcacccttgacctcccaggctcaagtgatcctcctgagtagctgggactacaggtgcctgctaccatgcctggctaatttttttttcttttttgttgagatggagttttgctcttgttgcccaggctggagtgcaataatggcgcgatcttggctcaccgcaacctccgcctccggggttcgagcgattctcctgcctcagcctcccgagtagctgggattacaggcatgcaccaccatgcccggctaattttgtatttttggtagagatggggtttcaccatgttgatcaggctggtctcaaactcctgagctcaaagtgatctgcccgcctcggcctcccaaagtgctgggattacaggagtgagccactgcacctggactgtttttttgtattttttgtaaaaacggggtctcactatgttgccctggctggtctcgaactcctggcctcaagcgatcctcccgcttcggcctcccaaagtgctgagattacaggcgtgagccactgtgccactgcccctggcttaatcatcatctcattttgcggatgaagaaactcaggccttgaaaggaaagtgaggccgggcgcggtggctcacgcctgtaatcccagcactttgggaggccgaggcgggcggatcaccaggtcaggagatcgagaccatcctggctaacacggtgaaaccccgtctctattaaaaattcaaaaaattagccgggcgtggtggcgggtgcctgtagtcccagctactcaggagactgaggcaggagaatggcgtgaacccaggagacggagcttgcagtgagccgagatcatgccactgcactccagcctgggcgacagagcgagactctgtctcaaaaaaaaaaggaaagtgaccttctcaggagcacaaagacccggggggtcttggagacagtacttggctcaggtgtctgatcccagcacaaaactgtagataaaataaccctggtgaaaaagcccatcacagggcctgggagggagaacattgctcgtggttctgacccgcagctttccttgtttatgaaatggatacagccaggcatggtggctcacgcttggcatcccagcactttgggaggccgaggcgggcggatcacctgaggtcaggagttcgagaccagcctgaccaacatggtgaaactcccgtctctactaaaaatacaaaaattagccaggcgtgatgacgcgcgcctgtaatctcagctactctggaggctgaagcgggagaatcacttgaacccgagaggtggaggttacagcaagccgcgatcgcaccactgcattccagcctgggagacagagtgagaccctgtctcaaaaaaataaaaataaataaataaaatagaagaaagtaataatggggcggactctcgtgattgaggtctccaaatgccctcaagtgcttcaggagtatcctctcctcactgcctcccagctctgctaaggcctgggcagtgtttgtgcccacgtggaagatgagaaacaggctcaggacagttaggcgacttgcctgaggtcacacagcgatcgcgtcctggccttggggtctggcgggtgggcaggaggggcgtgattctcttcctgcggctttcgacgttggttgctgccaccttcgtctttgacctgggtgatccatgggtggggctggggaggggcgtctgcctggctgggcttgtccacctgccccccaacttcagccctccgtggaggggtcagggctccagagggggcggatgtgactcgtcctgcatccaggctgccagagccgataacgctgagctcagcgtctgtctgcctgcgcgtctgccaaggaacctaattatttttagataagatggaggggcgggcgccggggcagagggagcacccaagctgggcgggcagtggggtcgtcgccatcagagagaccacccctcagcctcctctctctggggtccctgaacggcaacccaggactaacagccgggtccctgggactacaggggcagaggctgaggctaagggacgtgacgtctccaggactcacctctctggtcctcagtttccccatctgtaaaacggacatagtgatagacctcctgcatagggctaaggcggggctgaatgactgaacctcattttattttatttattttgttttatttattttattttatttattttgagacggagccttgctcttgtcgcccagactggagtgcagaggcatgatctccacttgctgcaacctctgcctcccgggttcaagcgattctcctgactcagcctcctgagtagctgggattccaggagcgtgccaccatgcccggctaatttttatatttttagtagagacggggttttgccatgttagccaggctggtcttcaactcctgacctcaagtgattttcctgccttggcctcccaaagtgctgggattacaggtgtgagccaccgtgcctggccgttttgttttatttttttgttgttgcttaatttcattttctgagatggggacttgctatgttgctcaggctggcctccaactccagtcgcccagactggactgcagtggtgcaatcctggctcactgcaacctccgcctccgaggctaaagcgattctcctgtctcagtctcccaagtagctgggattacaggtacgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattccaggtgtctaagttcttacccacgactgagccgcccctgcagaagcggagggcttacccaacatacgggtacactggcgctcacagggcctagctggtgtctgcagggtgcctggccagatgtctgtgaccctctagggcagcagccaagggaagggcccaaagagagaccccagggcctgggtgtgttttggggccactgtttgtctccatagcactggcccagcccaggactggggccaccagcatcgacacttcatctgctcctggggtggggtctctgtgatgccaccagtgtttcttccctctctttgcagatgcagagcaaagcggcagtccccggacagggatgggctctgaccaggaggacagcaagcccatcacgctgggtgagtctgggggcagcgtggcggtgaagggcggagggcgcagccctgtcctcgtcttttatttgggaatcatttgcttggcaccactcgttttacagatgagcagactgaggctcggagaggttaaggggcctgtccaggggctaccagggagctgggttggaacccacgactctgagctcccagcttctgggctctgaggtgctcaccccatgggagaccccagagggttctacggtcccatgggacgtttgagggtttttgtttgttttgttttgttttcattcatttatttattttgagatggagtctcgctctgtcatccaggctggagtgcagtggcacaatctcagctcactgcaagctccgcttcccgggttcaagtgattctcctgcctcagtctcccaagtagctgggattacaggtacctgccaccacacccggctaatttttgtatttttagtagagacggggtttcaccatgttggccaggtcggtcttgaactcctgacctcaggtgatccgcctacctcggcctcccaaagtgctgggattacaggcatgagccaccgtgcccggcctgtttgtttgtcttagaaacggtctcacgctgctgcccaggctggagtgcagtgacaccatcctagctcactgcagcctggaccagctaggctcaagcgatcctcctgccttagcctctcaagtagctgggactacaggtgtgcaccaccatgcctggcttttttttttttttttttttttttttttttttttgagatggagtatcactctgtcgcccaggctagagtgcagtggcgcgatctcggctcactgcatcctccatctcctgggttcaagcaactctcctgcctcagcctcctgagtagctgggattacaggtgtgtgccaccacggctggctaatttttgtatttttagtagagatggggtttcaccatgttggccaggctggtctcaaactcctgacctcgtgatccacccacctcggcctcccgaagtactgggattacaggcatgagccaccgcgcctggcttttttttttaattttttaaatatttttgtagagacagagtctcactatgttgctcagactggtctcaaactcctgagctcaagtgatcctcctgtcttggcttcccaaagcgctgggatcataggtgtgagccaccacacccagccctcatggggcgtctaatagatgggtaggacagtgtaattctatgttgtagggataggaagtgggaaaattaacctcacttagaccagagcagtcacttccatcctagcccccagctcctgcccttggcccccaccatttgtccttctcactatggccagaggacacctgtgagcccccaagtcagggcccgtccctcctctgcgcacagccatccacggctcccacctctcttggggtaaaagcccaggtcctccctgtggcccacaaggccctgcacaacctgtcccatccctgccctgtcctcccctcctccctctctccccgtcgtccactcccagccacacagacctcctcgccgttcctccagtgcaccagacccagtcctgcctcagggccgctgcacattctgttacctctgtctaaacagccaactaactgctcgcttgttctctccagatctcccctggtctcagctcaaatgcccccttctcagagaggtctaccctaaaccccttcagcataagcagcctctggctaccctcaatctttttttttttttttttttgagacagagtcaggctctgtcgcccaggctagagtgcaatggcgcaatctcggctcactgccatccccgcctcctaggttcacgccattctcctgcctcagcctcccgagtagctgggactacaggcgcccaccaccacacccgggtaattttttgtacttttagtagagatggggtttcaccgtggtagccaggatggtctcgatctcctgaccctgtgatgcacccgcctcggcctcccaaagtgctgggattacaggcatgagccaccgcgcccagcctggctaccctcagtctcagccctctgttttctttccttcagaggaagttagtgattgcctatggatttgcttagttgtttagtgactgcacgggtgtctgctcatctccccagtggaatgtcacctcctccagggcagaggctttgtctgtctacatctctgttgtgccctcagggcttagaatggggcctgatgcagagtgggtgctcaataaatacttgtagaaagaaaagaaggagagagggagggatgaagcagagagaagaagacaagagaggatatatggggagaggaaggaggagagatgaaaaagaaggaaggggccaagtgcggtggctcacgcctgtaatcccagcactttgggaggccaaggcaggtggatcacctgaggtcaggagttcgagaccagcctgaccaacatggtgaaaccgtctctactaaaaatacaaaaattagtcgggcatgttggcacacacctataatcccagctagtcgggaggctgaggcaggagaatcgcttgaacccaggaggcagaggttgtggtgagccgagattgtgcaccctgggcgacacagcgagactctgtcaaaaaaaaaaaaaaaaaagaagaagaagaaagaaggaaagaaagaaagaaaagaaagagagagagaaaaagaagggccgggtgcgggggcttacgcctgtaatcccagcactttgggggactgaggtgggtggatcacctgaggtcaggagtttgagactagcctgatcaacatggagaaaccctgtctctactgaatatacaaaaattagccaggcgtggaggcacatgcctgtaatcccagctacccgagaggctgaggcaggagaattgcttgaacccgggagacagaggttgcagtgagctgagatcgcgccattgcactctagcctgggcaacaagagtaaaaactccgtctcaaaaaaaaaaaaaagaaaagaaaagaaaaagaaggaaggggccagggcgcagtggcttacacctgtaatcccagtactttgggaggccgagtcaggtggatgacctgaggtcaggagttcaagaccagcctggccaacatggcgaaaccccatctgtactaggaggacacgggaggctgacgcaggagaattgcttgaacccaggaggaggcggaggttgcagtgagccgagatcacgccactgcactccagcctgggggatagagtgagactgtctcaaaaaaaaaaaaggaaaggaaaagaaggaaggaagagaaagcgagtgggtgaggcgtccttcttggaaggaccggaacaggcatgcacagggaggctggaaggttctcggaggttcacaggcctgaggccactcctcactggcccccggtgactcctccgtctgtgacccgggtcctccgcggcctcctgtgatccccagacgcctctctccaagccagatgttggagggaggtgggggcagcggcgcttggcctggtcccctggggagcttgggcgtctggtagaggaaatcacgtcctcccagctcgccagggagtcccccagagatggagctgagcaggcgctgcacaaacaggaaaccccggtcgggggaggcggagggggcgtgctgacaccagctggccagctgggtcagcaggaaacggctctggccacttctcctggacactcgggggccaccgctctgtcctcttcagaatgcgtggccctgaacctcccagcgcggggcagggttggttcattgccttcactcagcaaatgactgtaacagggggccgggtgcggtggctcacgcctgcaatcccagcactttgggaggctgaagcgggaggatcgcttgagcccaggagttcaagaccagcctgggtaatatagcaagaccctatctctacccaaaaaaaaaatatacacacacacacacacacacacacacacacacacacactagccccaggagttcaagaccagcctgggtaatatagcaagaccctatctctaccccaaaaaaaaaaaaaaaaatatatacacacacacacacacacacacacacacacacacacacacactagccaaacacggaggtgcatgcctgtaatcccagctacttgggaggctgaggtgggaggatcgcctgagcccaggagtttgagaccagcctgggtaacatagcaagaccctatctctacaaaaagtaataataataatacaaaaattagccaagggtggtgatgcgtgcctgtagtcccagctacttgggaggctgaggcaggagcatcacttcagcccaggagttcgaggctgcagtgagctatgattgcaccgctgcactcgagcctgggcaacagagcaaaattctgtctctaaaaaagaaagattgtaacagggggactggcgggggtttgggtctgcagaactggacacagccctgagctccctgcagtccgtgctgccccctgggggccgggagaggaactgctcccaccgccacccaaaagccaagagcctgtcccacctccaaacctaccaggctccctggctctttccactccaaccctgctggcctgcaacttgccaagtgcatttctacccggaggcctttgcacgggctgttcccagtgccgggaacatcgtggccctcagggaggtgatgaaacatcatccccatcggagaagccaacagtcacggggcggttgccaggcgctgttctcggagctttgcagattttaacaagttccttcctcttatccagtctcatcttgaggtctgtaaaatgccaccatctcggtcaggctttctctgagccctgggtgtaaaatagcctccctccccaccctagctagttccccaccagccgcctgccttaccacaggctgatgcacctcgcatttgacttaatgagcttttaatttgtagtaaaatgtgcatgatgtacaatgcatcattttagccatttttaagtgtccaagtcaaagtgcactaagtacattcacctctatctaattccagaacctttctttttttttttttttacccccaggctggagtgcagtggcgcaatctcggctcactgcaacctccaccttcctggttcaagcaattctcatggctcagcctcccaagtagctgggatcataggcacatgccaccacacccggctaattttttgtattttcagtagagatggagtttcaccatgttggccaggctggtctcgaactcttgaccttaagtgattctcttgcctcagccttccaaagtgctgggattacagatgtgagccgccgagcctggcctaattccagaacatttcatcccccctaaaagaaaccccatccccatcagccaccactccctgtctcctctcccagccctggtgcccacgcatccccttcttgtctctgtggcttggcctgtcctggacatttcagtgaaatggctcatgcctgtaatcccagcactttgggaggccaaggtgggtggatcatgtggtcaggagttcgagaccagccggaccaagatggtgaaaccccgtctctattaaaaatccaaaatttagacaggcactgtggcaggtacttgtaatcccagctacttgggaggctgagacaggagaatcgcttgaacctgggaggcataggttgcagtgagccaagattgcgccactgcactccagcctgggcgacagagtgagactccgtctcaaaaaaaaaaaaaaagaaaagaaaaagaaagaaagaaatggcatcacacactgtgtggccttttgtctctggtgtccctcactgaatgatgtcctcaaggtgcatccatgttgtagcctgtgtcagagcctcgttcttttatttttatttatttactggttttgagatgaagtctcactctgatgcccaggctggagtgcaatgtcgcgatctcggcctgtagctgggactacaggtgcccgccaccatgcccggctaatttttgtatttttagtagagatggggtttcaccatgttggccaggctggtcttgaacccctgagctcaggtgatccacctgcctcagcctcccaaagtgctgggattacaggtgtgagctaccactactgcgcccagcccaaggcctcattctttttcttttccttcttcttttttttttttttttttttttttttgagacagggtcttgctctgtccccgaggctggagtgcagtggtgcaatcatagctcactgcagcctcaacctccagggctcgagctatcctcccgcctcggcctcccaagtagctgggactacaggtgtgcaccaccacgcccagctaatttttgtactttttgtagggatggggtttcgccatgttgcccagtcccgtctcaaactctggggctcaagtgatccacctgcctcagcttcccaaagtgctgggactataggcacaagccaccatacccagctaattttcgtattttttgtagacacagggtttcgccatgttgcccgggctgatctcaaactcctgagctcacgagatccacccacctcagcttcccaaagtgccgggattacaggcatgagccaccacgcccggcatccttttcacggctgagtcctattccagtgtgtggctagaccacgctgtgtttatctcttcatcttttgaagggacatttgggtggctttccagtttgagctgtggtgaacagtgctgctaggaacattcgtggacttttgctgacctattaatcttggctgctgtctgtcgctcacactggactttgagtctcacaggggcaactgcttcagcctgtatcatctcctgctgtgccggggcccagctcagaatcagacactgtggatgcttagtaaacgcctgttgagtccatgaatccctcctacaagggcgtccgagggcaggacagggctgtccccaagctgtctgaggttggccaaggctcccgacctctcggggacaacttcgatttccaaatctgtgaaatgggtccaaaccactccagtcgagaggacagtctcccttcctttaatattaggtaggagcaatgctggggacactgagggttttaactgcggcttgtgggcctcccattcaaccccccattttaactgacccattgctgggtgccaagctctggtctaggcacgaaggacactgcagggtcggggcagacagacatccctgcccacacggacctcccagtctgaaggggagaagaacaagaagccagagtatctcgaagggtgacagtgtgtaaagcaagccagctgcccctcccaggcagttggatacagatctcacgacaaccccgatgatgggattgatggtttcacttttgcaattagggaaacttggaggctgagagagggaaagtgacctgccccagatcacacaccgaggcaggtgatggagccgatgtgagcccaggcctccgctttccgctcttttttttttttttttttgagatggagtcttgctctgttgcccaggctggatggagtgcagtggcgcaatctcggctcactgcaagctccacctctcgggttcacaccattctcctgcctcagcctcccaggtagctgggactacaggcgcctgccaccacgcccggctaatttttgtatttttaggagacagggtttcactgtgttagccaggatggtctccatctcctgacctgtgatcctcccgcctcggcctcccaaagtgctgggattacagacgtgagccaccgcacccggctccactcgttttttaagagagggtgtcgccctgtttcccaggctggagtgcagtggcacaacaatggttcattgcggcctccacctcccaggctcaagtgatcctccagcctcagcctcctgagtagctgggactacaggcacggaccacaacacctggctaattttaacactttttgtagagatggggtctcgctgtgttccccaggctggtcttgaagtcctgagctcaagcgttcctcctgcctcggcctcccacagtgctgggattacaggcatgagccactgcgcccggcctgctgttcacttgaatgcagcattccacagcatgggggaacccggatgaaggctgtgtgaaggcccacactggacaaggaccccccacggggccttccccatcagactggagctgtcattcccccacagcacaggatggacagggggaacgtccaggctcgggccagcccccaggagtccaggcagccctggagtgtggggaagggaaacaggcccagctcagcctactgaccccgctgtcttcctgttccagacacgaccgacttccaggagagctttgtcacctccggcgtgttcagcgtcactgagctcatccaagtgtcccggagtgagtgttcccgtcagccctgagctgggtcttggagaggggagggggccgcagggaggaaggagcccacccccctcaccctactccttgtcctttccagacaaccccctgtgtcactaagccaaggttcctagaaagggaggtggccaggcccttcccagagcccaaggtcagggctccctcccacctctccaggaaacagaatctaaatgctggatggcaactaaggaaacttctgccccagcatccctcctcctccctggggcctccactgtcctgtcccaggagaccccaaaggaccccgcccctcctgtccccttgctttctctgctgacctgctggggacccagcacattccgtcacacactgtctgaatcccaccccagcgagtcctgggcgctgtccttctttagccctgactgacaccttccctgtccagatcagcagagcctggcctccagctttggctacacctctgcctcacagtgtgctcttggcctctccccatggccttggtcctctgatccatagaataaaactggtttcagccaccctaggaaccgggccaatatgggaagggggtccccctttggactgcacccagtggctttccctacctctctaaagcaaaccgcagcactgggcactgcttcctgcctcactctcctctgtcaccctctgcagcacccgtggtgactggaacaggacccaacttctccctgggggagctgcaggggcacctggcatacgacctgaacccagccagcactggcctcagaagaacgctgcccagcacctcctccagtgggtaagtacccaggtccccacctctgggcatttcatgaccccattcatcaacccatcccctctggcccgagctgactcattcctctccctggaatacctcttttcacgattcacctggcctgagaaactcctactcatctcatccttcaaaacccagccagccccacgtgcctcttcccctagccctgacagcccaccgtgggctcccccagcctcaagtcctgccggctcagccagcccttaggaccctccccacccagaagaatgcagacacaggttgttgctgagatatgctttgtgacctcgagcaggtcacactgtgtgtgccccagtttccccatccataaaatgggatcatacccctaacaggcagttctgaggactacaggtggccaggagattagccaggctgcctgggttttggtctccaccatgctagcttggtgtccgacctgtgttgagaccctccctgcctctggcccgggtgtcccatccaagcaatggacaggttggaacaggcgttcgtagggaacgggctgaacgcccgcggctcccgcgatgtctcgcgatactacctccctcgcccccgctcacttaaggaccggaagtagcaaagcccgccgtcgcgccccccgccccgcgtctccctggtaaccagcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggtagggctggtggcgggggcggagccggccttccggtctgagtcaccgtggcgggaactacgtcttccggcagccactgcgcgggcgccgcggggcaggaagccggcctggagccgcggggcctcctgggaattgtagtcgtcccgagctgcgcttggctggaagtacggtccgggttcgcgttctcggatctctttggttccgctgcggcgaaggagggcagagactgtcccctgcctgactctcctgccctccggccgtgaatgccacatctctgtggggtccccgagctgcaggatggactcagtagtgactctgatcaacagggcgcctcttcctgggatctgtcatagaatccctcgtctgtagggaccctgtttgtcctcttcccctctagaaggtcctgagatgccggatcccttctcattggggtccttcttgaggttacttttttttttaaccaggttcccatctccatgggatcttctggttctgcaggagactcgtctcctttctgtagggtctccattcccatggcgtcgttttctaggaagattttatcctcttgcttttctgtcttcagaagggtcctctctggggtgtctttctttctttctttctttctttcttttttttgagatggagtttcgctcttgttgcccaggctggagtgcaatggcgcgatctccgctcactgcagcctccacctccctggttcaagcaattgtcctacctcagcctcccaagtaactgggattacaggcatgcaccaccatgcccggctaattttttctatttttagtacagacggggtttcaccatgttggtcaggctggtctcaaactcccgacctcaggtgattcgcccgcctcggcctcccaaagttctgggattacaggcgtgagccaccacgcccggcctctgtttttgtttgtttgtttgtttgtttgtttttgaaacggagtctcggtctgctgcccaggctggagtgccggggtgcaatcttggctcactgcagcctcgacctcccaggttcaagtgatcctcctgcctcagcctcccaagtatcggactgcaggtgcatactgccatgcgccgttaattttttttttttttttttttttttttttggtagagatggggtctcactatgttgcctaagctggtcttgaactcctgagttcaagtgtgatctttcctcctgcctcgtcctcccaaagtgctgggattccaggtgtgagccaccatgccgggcccctcttatttttttttaatttttgttttttgagatggagtcttgctctgtcacccaggctggagtgcagtggcgagatcttggctcactgcaacccttcctcctgagttcaagcaattctcctgcctcagcctcccaagtagctgggattacaggcacccaccaccacacccggctaatctttatatttttagtagagacagtgtttcaccatgttggccagtctggtctcaaactcctgacctcaggtgatccacccacctcggcctcccaaagtgctgggatgacaggtgtgagccactgctcccggccacctgtaggatttttagaagcagtataacattaggattaagaggtcagattcaggcattggagagacctgggttcagatcccagccctgcccgtgtctagctctgtgtgctgtgtaacctggggcacatcacttaacttctctaagcctcagtttcttcatctccacaatgggggtgatgtgaataatgttctttgggagctacaggaggaggaagggtaggatgtgcgtgaagcaaccgtctggcccatgcgacatacccgggaaacgggaggtcactgtcatccacgtctttataacattcctgtctctgaccaggctcggtggctcacgcctgtaatcccagcactttgggaggccgaggcaggcggatcacgaggtcaggagatcgagaccatcccggctaacacagtgaaaccccgtctctactaaaaatacaaaaaaaatagccgggcgtggcggcgggtgcctgtagtcccagctactcaggaggctgaggcaggagaatggcatgaacccgggaggcggagcttgcagtgagctgagatggcgccactgcactccagcctgggtgacagagcgagactccgtctcaaaaaaaaaaaaaaattcctgtctctttccggcactcggacgcatctagttgtgacatttcaggtgccaaggcccctcccttccacagtgtgggctcccagagcaggaacattcctaaagggtctccatccctcaggggacctgtctcagtatttatgaggttctttttttgtttgtttgttgtttttgttttgagatggagtcttgcttgttttgagagatcacgccagtgcacgccagcctgggcaacagaacgagactatgtctcaaaaaaaaaaaaagaaaaaaaaagtcacttctgtttcgttttttttgttttttgttttttgttttttttttgagacggagtttcgctcttatcacccaggctggagtgcagtggtgcaatctcggctccacctcctgggttcaagtgattctcctgcctcagcctcccgagtagctgggactacaggcgggcaccaccacaaccagctaatttttgtatttttagtagagacggtttttactatgttggccaggctggtcttgaactcctgacctcaagtgatccgccaacctcaagtgatccgcccatctcagcctcccaaagtgctggcattacaggtgtgagccaccgcacccagccgtgacttctcattaactctgtaattgatgaggctgtcagaatgtaaactgcacgctaattaaagtgaaagaccacctttgcgatgagccaaagcaaccctgagaggaaaaattgtagctttaagtctatttattaggagaggagaaaggtggaaaataaagaatctagctttcaacagagaaaactcaaaaagaaaacattttaagctctggagctcagtctgacttttctgcccggctgctcactggcaaccccttccactggggaaggaggtggtagcaatggggggaggacaaagaggaagcccccaccagcttctgctctgtgattgggaatcgcagagctagcagggaatgtcagaggaggtctgtgctcctgcagcttccacttgattacctcaggggatggcaaactcactccctcctgagggtttcttttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcacccactaccacgcccggctaattttttctattttcagtagagacggggtttcaccgtgttagccaggatggtctcgatctcctgacctcgtgatccgcccatctcggcctcccaaagtgctgggattacaggcgtgagccaccgcacccggcctcctcctgagggtttcatcctcagtgtaaagccctcctgtgtgctggccctacctgaggccctggggacacagagatgatccaacccactcttgtccctaccttccaggggctaacagcctagtgagggagatgggtttttatccaggtgactacagcccagaggaggaggcacagaagacagtcagggggaacaagaggaccctgatagaacttggaagaaaagggaggacctccccgaggaggagaatcaggctgacagagcagtgaggagctcgggcaactggcttctctgcttctccagctgtgtgacatttggcaggttccttaacctctctgcccctcaatttcctctgctatacgatcaggttgctggccgggtgcagtggcttacaactgtaatcctagcaatatggcaagaccccatctctacttaaaaaaaaaaaaaaaatagcatcacatagtggtgtacacctgtagtcccagctccttgggaggctgaggtgagaggattgcttaagacgggaggtcaaagctgccctgagctatgatcataccactgcactccatccggggcaacagagaaagaccctgtctcaaaaaaaaaaaaaaaaaaaaaaaaaaaaaaaaaaaaaaaaaaggctcacctgtaatcccagcactttgggaggccgaggcaggcggatcacctgaggtcaggagttcgagaccagcctggccaacagggtgaaaccccatcattactaaaaacacaaaattagccgggtgtggtggtgggcacctgtaatcccagctactcgggaggctgaggcaggagaatcacttgaacctgggaggcggagggtgcagtgagccgagattgtgccattacactccagcctgggcaacaagagcgaaactccatctcaaaaaactctgccttgatatcccagtgaagagaaaacactggaagaatttttttttttttttttttgtcagagtcttgctctgtcgcccaggctggagtgcagtggtgtgatctcggctcactgcaagctccgcctcccgggttcatgccattctcctgcctcagcctcccgaatagctgggactacaggcacccaccaccatgcccggctaattttttgtatttttagtagagacggggtttcaccgtgttagccaggatggtctcgatctcctgacttcgtgatctgcccgcctcggcctcccaaagtgctgggattacaggcgtgagccaccgcgcccggccaaacactggaagaattttaacacccgtggcccagggctggactttacgtaaagcacgcacctggggcgtgagagccgggtttattattaattcgcggctaagctacaaccgggatgatttaagtggatttatccgcagggaagatgatgggagggcattcccagcagggagaatcgtggtttgaggagttgcactgtggatgtttggggccagaccatcctctggggcggggctgtcttgggcactgttgggtgctgtgcagagttcatggcctccacccactccgtgtcaggagcaccccccagtggtgacaaccgtaaatgtccccagacctggccaaatgtctcttgcgggcagaatctcccctataatatagccagaggcatatgcaaagcacctaaacggagtggggagaaggtgcgtgacccctggtctgggccactcttttttttttttttgagacggaatctctctctgtcgctcgcccaggctggggtgcaatgcgcgatcttgactcactgcaagctctgcctcccaggttcaagcgattctcgtgcctcagcctcccgaatagctaggattacaggtgcccgccaccacggctggctaatttttgtatttttagcggaggcgggttttcaccatgttggccagtctggtctggaactcctgacctcaggagttccaccacacccggctaattttgtgtttttagtaatgatggggtttcaccctgttggccaggctgctctcgaactcctgacctcaggtgatccgcccgcctcggcctcccaaagtgctgggattacaggcgtgagccactgcgcctggccttttttgttttgttttgttttgtttttcccaaatagtgacttgctctgtcgcccaggatggagtgcagtggtgcgatcagcgcccactgggctcatgccatcctccttcctcagcctcccaagtagctgggactatgggcacttgccaacacacctggctattttttgtactttttgtagagacagagttccctgtgttgcccaggctggtcttaaactcctgggctcatcctcctgcctctgcttcccacagtgttgggatggcaggtgtgagccaccacacccggctggccgctttttctctatgtcccttcccaacattttagtcccagacagccctgcggaggtgcctggcaggcacctcattttgcagagggaaaccctgaggctcaaagaggtgacatcacctgctccaggtcaccccagcggcaagcgggtgcacagggacacggaaccacgtggccgttcccagcggccccactcagggtacctcgctctctttgttttatggggcatctgtgatgtcctaagccgggttatttcccctcccggcaacactctgtgagatcagggctgcccctggccatcagttgacaagtggggaaactgaggcccaaaggtcccacagcaaagaaggggcagagccccgagcttatgcccagtgcttcctgggcctctccccatcgctgtggcctgcatcggtaaacatttcgcagcctctgaagtcccaagggggacgcctcagaacaggcctggcccctgggctggagcagggttcctgaggttcccagtggggcccagctgtaacctcattggtggaccgaggcaagggccagaggggcccaagggaagggccagaggggccgggggcacaggaagggccggaggggctgggggcacggggagggccaggcttattgttgcagcctgcaaggctgtcccaagccgggtgcctccgcagagggaggacacaaaacaggaacccaggcaggcagggtctctcccgaaggtgcccttggcccctggccaccaccctgggatgctcctcctcctcctcggcatcctccccccacccttccctgccctttccagcttcctgtctagacagcccccaattagccactcattaagggggttaagctgattagagcagctctcccttcctctggcggactcggggccttttctcccgggcagtgctcagccagtccccaaccctgaggctcacagaggcctggggggatcatgccagcccgatgccaggcaagacccccaccccacacctccaggccccacattccagcctctaggctttgcccgcttggggcctgggccaggccctttctcctggccgcctccacccgaggcctccctgcttacgcggctgcgtggggtggagggaaggtgccttggagcagcccccactgtgctttgtttttgctgcttgtgtagctcccccttgaaggcgacaaaggtcccgtccacaggcggttattacacagggcggggcaggcagcccccatccattcctctcctctgtcaccccaggcttcccatcccttttttttttttttttttgagtcagaatctcactctgttgcccaggctggagtgcagtggcatgatctcggctcactgcagcctctgccttccagattcaagcaattcttctgcttcagcctcgcaaatagctgggactgggactacaggcgcctgccaccatgaccagctaatttgtgtatttttagtagagatggagtttcaccatgttggccaggctggtctcaaactcctgacctcaagtgatccgcccgcctcggcctcccacagtgctaggatgacaggtgtgagccaccgagcccagcccgcccatccctttttttaaccccagggtggaggctagtgcaacgtggcctggggagggacagagttgggttccaactccacctccacccccccttggctctatggccttaggcgagtgacgtcccccatcaggcctcagcctccacatctgtgaaatgggcgcagctcctgtaagctctgcacggggcagctgtgaggaccacattaagagaggaggctagtgccttcacagaaggtcctcacccagggcgatgctgccccacccccagggacactggccggtgtctagggacatctgtggttgtcacaactgggagagctcttgacatggagtgggtcgaggccagggatgctgcttagcaccctgcagtgcccaggacagcccctccccagggaacgagccagccccaatgtctacagtgctgaggctgagaaacctgtattaattatgtagaaaaaaattgaggctgagtgtggtggctcacacctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccagtgcactccagtctgggcaacagcgtgagaccctatctcaaaaaaaaaaaaagaaaaagaaaaaagtctgccccctgctcacaacggaataaactcctagtgtggcagacggtgtgtaaaccagggggacccccagctcctgggactcacctcctctctccctccccactcaaggtgtggatttcaatgtgtgcagcctcctgggacctctgcagggcagaggatcatgggacgcagaggatcatgggacgcagagtctcttgggggtccatggaatcctctaagacagaggattttacctatgggtgatcctgaccccagaggacactgggtgacatctggggacctgtgtggttgtcacgactgcagggtggtcctggcatggattgggtccagggacaccgcttagcaccctgcagtgctcaggatggccccaccctagagaatgatccggtcccaaatgtccacagggcccagaggagaccttggtgcactgtcaacgccccgtggtcactgctgtcctcatcagattcatgccctgcatcggggcctctgtccactccacacactctgtgtagggcccctcctgaccccggaccctagagacccagccagagtgggccttggccccctgggggagccggcatttcagtgggagatgggcttgtttgttgagcaaacaaatggctgctccgacggggtgatgagggccttttgtcaaatacaaagaggaggtcagatgggcgtgtgtgacaaatggctgctccgacggggtgatgagggccttttgtcaaatagaggaggtcagatgggcgtgtgtgacaaatggctgctccgtcggggtgatgagggccttttgtcaaatacagagaggaggtcagatgggcgtgtgtgttaaacagacaggaagaagctctgatgggggagccctcgggcctgcgtcctcctcacagtcaatattctcagatggggcattcaggatgccgggagtggcgtatggatgtgttccctgagaggaaagatggccactgagatgggcgggggacgcacatgcccgctggctgaacagggaggtcccacaggggtcccaggcatgcctgctgaacagacagaggatgcttggaggcggggtgcagagtcagtgtccgtagagcctgccgggagcgtgccggcttattctttctcgcggtgcctgagctgcgctcccccctccttcctgccctgccctggctgccgctggccccatctcaggaagctctagcggtgcctgcagggatgtggcggccgggggtggagtctgagccagactatttccatccaggacaagcggttctaggaaatcctcctaaatgagcgtctgacaaccctaacctcgttcccgccgtggccctgcgcttgcagggagctgccagcccctgcacacacacacacacgcttgcacacacgcatgcatgctcatacatatatgcacgcacgtgcacaggcgtgcacacatgtatgcatgcatgcttgcagacctgtacgtgtgcgtgcaagcacacatacatagacatgaacatgcatgtgcaggcatacacatacatgcatatattcacgtgcacacgcatgtgcgcattcacacacatagacacgtgcacaggcatacacatacacagatatgaacgtgcatgtacaggcatacatatgcaggcgtgcacacgtccacatatgctcacatgcgtacacacacatgcacagacatgcacacatgcatgcagctgtgcacatgcgtgcaggcatacacacatacatgcacgcacacacatgcatgtattcacatgcacacacacacgtgcacaggcatacacatgcacacacacgtgccgacaagaccagcctggcctccccggctccaggccaccctcattcctgccacatcctcctgccctggaaaagcccgggcctggctgctggggcccagcttggtcacagacttcatggcatcccactgggcagtggggcctctctgggtggctcagcctcgatgtccgaggcctcaggagtgttcccccttgagtgttcacaggctgggcatgagtggaggtgtcatccttcctgccccccatgtgggtgtcctgggtgcccgcctcctccagagccgggtgttcccgggtccctgggaactgctgacctgcttctggggtgtgtcccagtgacaccttcactcctcacagcatggtgtgtgcagggccatggggacagctggttccataaccacaaaagcagatgaagagctgcatgtccccccacagctgggtcctggatctgggctccccctgggctgcagccatcagagaggacggaagttccctgagtggtaaccccgttcagggaaggatgcagcgatgctgggaggatggaggaggtggggacaggactggggagggcctgtaccacacagatgcctgcaggtgcctatggaaccaccagcaggagacccaagacacggtgacatcctcaccgtttctcatcagggcatcacccggggacagcaggtcacatctggggacatccgtggttgtccccactgaggggcgctcttggcacggagtgggtggaggccaggggtgctgctcagcgccctgcagtgcccaggacagctccctacagagaccgatctggcccccacatcagcagtgctgagactgagaaatcctgcgtgaattatttggaaaatattgagttacgtcactgctcacaccagacaccagaagaagctcctgacagggcagacggtagaaaccagggggaccccagctcctgggattcacctcctctctccctcctcactccgtgtggatttcagtgtgtgcagcctcctgggaccacagcagggcagaggatcatgggacatagtctcgtggagggtccatgggatcccctaacccagagggtctcacccacacgtgattcttgcccagggtacttttggtgatgtctggggacatctgtggttgttacaaccgggggtgctcctggcatgaagtgggtggtggccagggactctgctcagcaccctgcagtgcccaggagggccccaccccagagaatgatccagccccagtgtccacagtgcctgtctgagagaccctggaggtaaggaactccaagggccaggtcgaagggaagctaaactcatcaccctgtttggatggtctcagtagatatgttttaccttaaaagaaatgtaaaaatcctttctaaaaattcggctccccagggcacgcctccctgagattccatttccagggatagggtagggcccaggacactgcatttctcaggcaagatgtgatccttagccctcacttgaaaaagcttctctggggccaggcactgtggctcacgcctgtaatcccagcactttgagagaccaaggcaagaggatcccttgagcccaggagtttgagaccagcctgggcaacatagcaagaccccatctctaaaaaaaaaattgcctggacatgatggtgcatgcctgtggtcccacctacctgggaggctgaggtgggaggatcacttaagcccaggaggttgaggctgcagtgagccatgatcgtgcctctgcactctagcctgggtgacaaataactcggctgggtgcagtggctcacgcctataatcccagcactttgggaggccgaggtgggtggatcacctgaggccaggagtttgagaccagcctggccaacatggtgaaaccccatctctactaaaaatacaaaaatgacccgggcgtggtggtgggcgcctgtaatcccagctactcgggaggctgaggcagtagaatcgcttgaacctgggaggcggaggttgcagcgagccgagatcacgccattgcactccagccagggcgacagagggagactctatctcaaaaaaaaaaaaaaaaaaaagacacagccccagaaggccaggcatttcggctccagagctgggactccaccccagcctcctggaaatacccaaaatggccctctttggggctctgtgttcccacttcattttgaagacagggtgaaagtgtcaaggggcaccgtgtcatctccccactcaccccaaatagcagcagcagcggctcctgcagtagctaacattcttccagctgggtggctgacgttccctcggaaagcagggctgaaggcatcctcagagaatgccccgatgcccagggatctgggacggccatgggcttcacctgcacaggcacccctggcccaatcctcacagctgccactcccacactgctcccgatggaaattccagagctttacagaatcccctgttttatgaaaaggggtagacgtggcagctcaccccaggtcgcacagcctcatggccagccggggtttgaaccctggaccacctgcttcccccacacccaggggctttccagggggtgcctggagggggagggaagccgatgtttggtgggtgagcctccctgagtccatccgttttttgtttgtttgtttacttgcttgtttgtttttgagacagtttcacagtttcattcttgttgcctgggctggagtgcaatggcgtgatctcggcccactgcaacctctgccgcctgggttcaagcgattctcctgcctcagcctcccaagtagctgggattacaggcgtgagcccctgcacccgactatccatctgttttttgtgtttgtgatggagtcttgctctgtagccctggctggagtgtagtggcgtgatctcagctcactgcaacctctgcctcctgggttcaagcgattctcctgcctcagcctcccaagtagctgggattacaggcacccgccaccacacccacctaatttttgtatttttagtggagacagggtttcaccatgttggccaggctggtcttgaactcctggcctcaagtgatctgcccacctcagcctcccaaagcactgggattacaggcatgagccactgtgcctggcctctgtttcttcattcattgattcactgaggaaggtgtgaggggctgagctgctgagttgggggctgtgggggcttttgtcccaggcagcctgggaggtagtgaggcccctgtctgcagagtgatgccagcaagtcactgcagaggggggatgcacctcatttcagccccagggaggctccgttccttcctcccgcgtggacgagggaaggcagagctgagctggggcttgtctgtgcgcccttagccagtcagggtctaactggacttcggatctgactgtctctgccctccctgccaccttctctagggctcgggtgactcccaggtgatggggcagccctgagccttcccatttctctggaaggagagtaggcaagggccaggagcgaggcccaggggcacgtgttgatacccagctctccatcccccggctgtgccgccctggctagccccttctctgctctgagccttcgtttactcctctgtgtaatgggctcacagcctctccccctcaggattctggggtaagaggaggcggggtgatgaggcttcctatcccttcggaggctggctttggggaaggtccagggctcatggggtgtgaccagcctgtgactctctcgtcccatcccctccacaggcatctcgtccccggtgaagaagacagagatggacaagtcaccattcaacagcccgtccccccaggactctccccgcctctccagcttcacccagcaccaccggcccgtcatcgccgtgcacagcggtaagcgccacgggcccctggcggggaggggcggcgggccctcctatcaggcctctcacagccggggaagtcccactggatgtctgaccatgagtcctattgctgtagccttctaggtgggcaaaaaaccatagaggtgccgtagtggagagcgcccagggccttgttccagcccggctgagaggttggactcagtccctttgggcctcagtttcccccctgtataacaaaaggctgcaacctaacttcacctcactcccctcacccccgtctcaatctaatccccccattccaaccccagacactgatggacaggcaggatcagaagctgccaatgaggccaggcacagtggctcacacctgtaatcccggcactttgggaggctgaggcgggtggatcatctgaggtcaggagtttgagaccagcctggccaacatggtgaaaccccatctctactaaaaatacaaaaattagccaggcgtggtggcacgcacctgtagtcccagctactggggaggctgaggcaggagaattgcttgaacccgggaggtagaagttgcagtgagcagagatcacaccactgcactccagcctgggcaacagagtaagattccatctcaaaaaaaaaaaaaaaagctaggcttggtggctcatgcctgtaattctagcactttgagaggccgaggcaggcagatcacaaggtcaggagttcaagaccagcctggccaacatggtgaaaccccttgtctactaaaaatacaaaaattagccgagtgtggtggtatgcgcctgtagtcccagctacttgggaggctgaggcaggagaatcgcttgaacccaggaggcagaggttgcggtgaggcgagttcacgccattgcactccaacctgggcgacagagcaagaccctgtctccaaaaaaaggctaagtgcaagtggctcacgcctgtaatcccagcactttgggatttcaaggcgggcggattacgaggtcaggagattgagaccatcctggctaacatggtgaaaccccgtctctactaaaaatacaaaaaattatccgggcgtggtggcaggcgcctgtagtcccagctacttgggaggctgaggcaggagaatggcgtgaacccgggaggcggagcttgcagtgagccaagatcgtgccagtgcactccagcctgggtgacagagcgagactccatctcaaaaaaaaaaaaagagacatctccatctcggccaggcacagtggttcacacctgtaatcccagcactttgggaggccgaggcaggcggatcacctgaggtcaggagttcaagaccagcctggacaacatggtgaaatctcgtttctactaaaatacaaaaattagctcggtgtggtgatgcatgcctgtgatcccagctactcaggaggctgaggcacaagaatttcttgaacccgggaggcggaggctgcagtgagccaagattgtgccattgcactccagcctgggcaacagagcaagactccatctcaaaaaaaaacaaaacagaacaaacaaaaaatcaccttccatggttgccattgggattaaggggggtgaattgtaggaagcctcaaatattgcttaccaccccatgttctagtgatcaactatttagttctttacacagtcatgcacacagagaggcagtcccaaatcaaagcagccatttgggccaggggtcagcaaacgctggccccctggttgcctgttcttacgaataaagttttattggcaaacagccacgaccacgtctttgtatatgtcctgtggcagctctcaccctgtcttggcagggctgagtaattacagcagagaccacgtggccaaaagccaaaaatatttactatctggccagaggctgtggagatgagggagtgactgctataaatagtgaaaatactaaaaatcactgaactgtttagaaagaggaaaaggcaggcaccacaatagaatatgactcagccatgaaaacgcacgaggctctgacgcaggccaccttgaggacgtcatgctcagtaagagaagccagacaaaaaggccacacagcatgtgatctcatttctatgaaatgtccaggacagggccagccacagaggcaggaaggggatgtatgggtgctggggctgggggaggaggtgaggagtgacggctgatggagacggaatttctttatgtgctggaattaggccgggcacagtggctcatgcctgcaatcccagcactttgggaggctgaggtgggtggattgcttgagtccaggagtttgagaccagcttgggcaacatgatgaaaccccatctctactaaaaatacaaaaaattaaccaggcgtggtggcacacgccggcagtccgtgctactcaggccgaggcaggaggatcacctgaggtcaggaggtcaaggctgtagtgagccatgatcatgcccctgcactccagcctgggtgacaaagcgagattctatctcttaaaaaaaaaaaaaaaagatcactattcagccatttgcagaaagagcttgccaaccctagatttatagtgtagactgtggggccagatgggctgggttcaaattcccggtctgccatctgatgccgtgtggccccaggcaggtgacacatcccctgaaggccaccctgtcatcctctgtttaaaaaaaaaaaaaaaaagacggggccaggtgcagtggctcacgcctgcaatcccagctctttgggaggccaaagtgggcggatcacctgaggtcaggagttcaagaccagcctggccaacatggcgaaaccccatctctactaaaaatacaaaagttagccaggcatggcggcgtgcacttgtaatcccagctactcgggaggctgaggcagaattgcttgaacccaggaggtggaggttgcagtgagctgaggtcataccactgcactccagcctgggtgactgtctcaaaaaaaaaaaaaaaaaaaaaagaccaggctcagtgggttacacctgtaatccccgcactttgggaggcctaggagggaggatcgcttgagcccaggagttcgagacctgcctgggcaacatagcaagacccccacctctacaaaactaaaaaattaaattaaaacacaaggataatatcacagccccagtggggttgccgtgggagtcggggaatttgggtgtcaatgtggtcagtgctgctgggtttttttggtggttattgttactaaacgcactgagatgccggcaggaatgacacccacagacacacagtcacacggtcacagagcagaccggctggagcccccaagtaacccccgcttcccactgtctccgcagggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccggtgagttgggcggggcgcattcgggcctctcctggcggctccaggtgacctcccgggggccacgtgctcacacgaaggcacaacctctgcttaaaagggtcttgaggacttggctctgaagtcccctcctctgtcgtgctgggaggcagctggattgggtcagaattgagatgctttcggatgtcagggtttcgggcgcatcatgtcgcaccctgtggggtctgggtagcacccgtaggtcccagcaactgcgtgagtcgtactcatgttaacacaaggcagggagggactgggcatagcggctcatgcctgtgatcccagcgctttcggaggccaaggcgggaggattgcataagcccagagttcaagaccaacctgggcagcatagcgtgacccagtttctacaaaaaaaatacttaaaaatgagccacgcatggtggcgggcgcctgtagtcccagctactcaggaggctgaggtgggaggatcgcttgaacctgggaggtcgaggctgctgtgagctgtgattgtgccactgcaccccagcctgggtgacagaacgagaccctgtctcaaaaagaaaaaaaaggttggggggcggggggcaggaagacattgattacaaaaaaaccaccaaactcagttcgagcaagacagcgtttgccagactccacaggaagctttggatgttcagagcttttcggactttggaaccacgggccaggccgtggatgatggtggatgatggcgtgctcgcagtgaattaggaaaaacgcggagaacctgctgttaggaggcggtggcactgtttggaaggaaatcagtcgagttggcgtgcagggggtttacagaggagatgcagtgagcgtggccccagtagtgccgggctttgagtgacaccagcaagcgggtgtccccaggcccctccacctccggccgtcctcagacccaccaaacccgccatggtcacacccgcgccctggccccccagcctgccaccccgtccgggccgtgcacagagccgggggcggccggcgccagcagcccgaggtagagggggagcccaccccttaaccacgtgtctctctgttcccccagttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttgtaagcacgcgggaagcggtgccctggtggggcggatgtccgcaggggggcctgtcccctccccagccccactgccaggtcagaggtcaggcccgaccctgcagggcctggcgagtttggtgggtctccggaaaacagcccagtggccacgtggttgggcccatgtagggctgaggcagccttaggggctggccggaccaagcctcgggccagggtgagagtccagggtctgtccccttcgccgagtcacctgggggaccccggtgcccgccgtgggccgtcagaaaccctccctggtatgtcaggcagctgacagtggacacggatctcacagtggcggcccgagggccagactcgacccccagactggtcttttgtttgtggagaaagagaatcggttgttatcattttaaaatcaggacgttttacataaacatttccagagttctggcttcttggggagaaaggagctacaccaggcccagttcctttgggtgacctgggctggaccacacctttagatgggactctcttcgcctgtccacctgacctggaagcccctgggttggcggctgctgcaccttctagatttttctgctctctggatgtggttctgggtggctgctggatggcccctcggtcctggcatccctgtcctgaggtccaccccattcgtccgcagtggctctacccccagactctccccacgacccccatgcaggcttgggtgggtcacccaccctcacagggcgccagacatctctgaacccagagacctctccccatggactccatctgcccctcacccccctttttgagcatctctgtccctcactctccaaatgagaccccccaccccacccaagcagttggtggccacggttccttctaggtgccctcagctcctcttctccctgccccggcgttcctgtccccgtccccactgcgtgccagaacccaggctgcctgcccataaaaaccggcttctgatcactggctggaggagatcagccccaaatccaccctgggctggaatcccacctctgcagctctctcactgtgtgacctcaggcaggtgtcttcccctctctgagcctcagttttctcagctgcaaagtgggtttgccttggtgcccaattcacagggcagtgggggacaagccggtgacatgggtcagggaggcagagaggacattccatgtggcgcctgatgctgcgtggtgtcaggcagctgtggtcattcttgccggctgtccctgcctgctcatctgtgaaatgggagcgttgactgcataggatccagtcagggctcagtgggatcatgcccagagcctggtattcagtagacacttaataaatgcaggatactgcgtgggatccactcagggctcgatgggattatgcccagagcctggcatacagtagacacttaatagatgcaggatactgtgtaggatccactcagggctcggtgggattatgcccagtgcctggcatacagtagacacttaatagatgcaggatactgcgtaggatccactcagggctcggtgggattatgcccagagcctggcatacagtagacacttaataggtgcaggatactgtgtaggatccactcagggctcagtgggattatgcccagagcctggtatacaatagacacttaatagatgcaggatactgcttaggatccactcagggctcgatgagattatgcccagagcctggtttacagtagacacttaatagatgcaggatgctgcttaggatccactcagggctcggtgggattatgcccagagcctggtatacagtagacacttaatagatgcaggatgctgcttagtatccactcagggctcaacgggattatgcccagtgcctggcatacagtacacacttaataaatgcaggataggcatggattccacccccctttccctgcaccggggctcttaactgcaaatctactcctacttctccccataagcctcgctgcctccagctccccccaaccccagccaggacaacttggggaccctgcctgttgcagcttcttctccccctacctgggtcccggcctgtctgaggcccccatccctgctgtagccccaggccgtgagttactcacacgccgacaaaatataatcgctgaggctgaaatataaatacgcacatctgtatgtatgcacacacccagccctccctctgccctctccgggaggaagattaataaataaaacgccctcaataattcatgcaccccgcgcggaggcagccctcagtggcaggaccgggcgggcgctgcccaccctgaataattcacgggcggttttgtgaattacagagccatcctgccttccctctcagcagacaccccgcccacctgggcgatctcagccgtgacccccgggcccctcgagtcaggatccccgcctcccaaggaccttgggcctttcaggggggcccggttcaactgggggtagggcggcaggctcggaggccccaggcactgggtgcagaggcccggctgtgtgacgcctggcggtggccaccctctctggggccagggccgccccggctcccacaacccctcgctaacgggctctcggtctctctcctccctgcagcctactctccgcccgacacgtcccctgcaaaccgttcctttgtgggattaggaccaagggatcctgcgggcatttatcaggcacaggtaggggccgagaggccggctggtggggtgggaggggcagggcagaggggccggcccggggggctcagggcgaagagggcctgctgggtcccacgccacacccctggcacaggggcgccagcctcccacaccccacctgggcctcgagcccccacctggcctctccctgaggccaaatttccctccaccttggtcctggggggatggggtgtggccccagactcagcctgtggggtccccaggagcgtctctggagaccatcgtggtacagctatgggaccagtgtcattaccacctgcttcccatggtatagatgggaaaactgaggcccagagagacaagggggtctgcccagggtcacacagtgcatcaccctccctcctccagcctccatcccccatccacgccgaggcctagagggaccgcggggtggccgggggaaactgaggcagcccatggcggggcgtggggcctcccaggacagcatccaagcccccaccccaggcttcagcccacatctaagccagtgtgaggagtcagggcggagaggcttcgtcagcaggacagacaggatggggcaggggccagcgttcatgttcacgttgatgttcatagtcacgtacatgttcagacggctgcagctgagtgagcatggccggggtcccaccacccctagaaggcaggcaggcaggcaggaggttgacagaggaggctcagagaggggaagtcaattgcctgaggctgcacagtagtctagggagtgggggcgtgggagggcagccttagccccaggcccaggtgtccctcaccccccacccccataaggggctctgtgtaggccaggagtgtgtgagcgcgtcttcgggttatgggtaagcagctggacctttgagcctctgctctctccccggtttgtgttggggagagggttggaggatgtaggagtggctgccacaggcccgggaggtccagactcagagagaaacgagctctgggctacccagcggccacggaactgcagagcgtggagatgtatggggtccccaggggccgtgttcaaatcttccagccactgagggaggtttcctgctgcagagcccacgggcaagggtcacggggcctccccgggaccctgcggggctgtcctggctgagcggatgggggcggggaggggacatggcattccccctccctccctgtgctgggtgcccaggatgcctgtaagcggcccctccctctcttcccaggctccgcaaaaccagccggaggaggaagcagggatggaggctgcttctcctgagttcagaggagatccatgtgctatgggtggagggaatcctgggtcaggggccagggctccagcccagtgctggctcacccactctgaacctctgtctcttcctctggccttgggcacccgcaccaagagcctttgaagggcactgggggacagaaagggcactgaaaggttcaggcttccccacaccccgtaaatattaagtaccctgccttgcacccatagagccccggagagggagtaacttggtcagggtcccccagcgagcagacgtccaggactcctcgctttgggatttgggccccctatggccaacctctcccccgcctggtgctgatggagcccggcattacctctgccacccccaccccacatcgctccctgcccctgcgggaggctgggaacgtcttaagtggttcagaaaccaaagctaataaaagctgcggtgggaggaggcccagcccgcttaacccttccccagcctctgccttggaccaaactctctgaccaggccctcccgccagggcccgggacccttctctcagactgtgctggctccagccccaccccacccaagcctgggagggaagggaaactgaggcaggcaagggtggcacctttctcagcatccctatcttgactggctggactcctctggggacccagaaagggtgggaccagggctggcagaatggggtgtgggggggcactggcaaggggctcagcataggcaatggtgtgggtcgggggagggggagctggctggaatgtgagagatctccggtggcaggggccagacagatgatgcgggctttgctctggggtagtggggagccatagaagggtttagagggagggagtggacacccaccaggcctgggagtcagaactttctggagcacagaaaggaggtgacacattgtcaagaggctctcaggggagcatgggttagggggaaggcgaggtccccaaactgggcatccagggagcacaggtctggggaggaccccattgctgctgccctgactggactaagagcacctgggttgaggccgggcgccgccacctccctgcagaccccggagagagggagggaagaagcagtgagatcccgctctcccctctcccagctcccgctcaaagggccctgagcttggaggcctctcatttccgattctggccagtcagcacttctgcctccgcctcctctattcctggcggattcgcttccctctgccccctcctcccccaaagcctgggtgggcgcgcctttccctctgcctctccggctcccgacaccccccagtccatggactctccccccatcaatatccctccccgtgatctatgctaattgatctcgccctggtcagttacccacccatcgccccatgtccgtccctatcaatccccccactgtgaggctgggtggctctgacgccctggcccctcccctctgtgatgtccttcacgcccctacatttctcctgcacgggaacccacgtaagcagctgggtaaaccgagggtggggggcaaggcgggcattgagccacatgccgggagccacacaggcggctgcagccaggccagcaggataccagagcccaaacctcccccttcacacctactgcctcagtctcccctcagctgagtgggaggatgtggagttgagggtgcccccaccccacccccgccccattgctggggccacagccaggcaggaaggggaggggagggaagggaggagggaggaagggctgaggggaggctggtccaccacggggagggtcacgcccagagtctgtcggttgccaacagaaaccagacatgaggtaatggccaagatgaacttgaacttggctggaggtggggcgctgggaaccactgtggcgccagttccatgggctggcccagtggctgcctggttggaggggctctgttgaatgatttgctgcagcggtggggggcggccccacctctaacctcagttggggagtggaggggtctccccagttccagaggcacagccctcccctcacagtccaccctggatgctccatctggggttggagtttgcgtttccagggcaggggtctggacagcagcttctctgcagagactgaggccggagctgtccccaaatgacgtgaccttgggtacagccccatgcagaactcccctcccttagcctcggtctcccgcctctgggaggttgagagtcatcctcagcccccctgtgcttagtgagcttctgtggagcaagagggggccatccgggggacctgtgacaggatgggccctggacgcccaggacagtgctcagaagatgccaaggggattcctgagaggcaggcgagggggttggccctgggcaggagcagaaatgagagccagagccagacaggcctgagttcaagttccacctctgccgcttccatgctggtgacctcgggcaagttccttgacttctctgggcctcactttcttcacacaaaacagcggtggagggagacctaccccctccttcacggggataccggggacatcattaaagaggagaatttttttttgtttttttttggtttttttggtttttgttttgagacggagtcttatgctgcccaggctggagtgcaatggcacgatcttggctgactacaacctccgccccctggattcagacgattctgctgcctcagcctcccgagtagctgggattacaggcacgtgccaccacgcctggctaatttttgtatttttagtagagacagggtttcaccatgttggccaggctggtctcgaacccctgacctcaggtgatccacccaccttggtctcccaaagtactgggattacaggcatgagccaccgagcccagcctcttgtttactttttaaaaacattctcaaggccatgtgcagtggctcatgcctataatcccagcactttgggaggccaaagcaaacgaataagctgaggtcaggagtttgagaccagcctggccaacatggagaaaccccgtttctaccaaaaatacaaaaattagctgggtgtgatggcgcatgcgtgtaatcctagctactcgggaggctgaggcaagaaaatcacttgaacccgggaggcagaggttgcagtgagccaagatcgtgccactgcactccagcctggtgacaagagcgtgacgctgtctcaaaaaatcaacaaaaaacctctttataaagtgaacaaggcagctgatgtggtggctcatgtctgtaatcctagcactttgggaggaaggagttcaaggccagcctggtctacatggcgaaaccccacctctacaaaaaaaaaaaaaaaactagtcagatgtggtggaacatacctgtggtcccagctactcgggaggctgaggtgggaggatcacttgagcccaggagatggaggctgcagtgagctatgatggcaccactgcactccagcctgggcaacggagcaagaccctgtctcaaaataaaataataaattggctggccacagtggctcacgcctgtaatcccagcactttgggaggccaaggtgggcggatcacttgaggccaggaattcaagaccagcccggccaacatggcgaaacccggtctctactaagaatacaaaaattagctgggtgtggtggggcgggcctgtaatcccagctacttgggaggctaaggcacaaggatcacttgaacccaggaagcggaggttgtagagagccaagatcacaccactgcattccagcctgggcaacagagcaagactctgtctcataaataaataataaatagagaagaaaataatttttaaaatataaaataaaggccaggcagagtggctcacgcctgtaatcccagcactttgggaggccgaggcgggcggatcacgaggtcaagagagtgagaccatcctggccaacatggtgaaaccctgtctctactaaaaatataaaaattagctgagtgtggtggcatgcgcctgtaatcccagctactcgggaggctgaggcaggagaatcacttgaacctgggaggcagaggttgcaatgagccgagatcatgccactgcactccagcctggcaacagagcgagactctgtctcaataaataaataaataatataatataataaagtaagattgagttccagactgggagtgctggctcacacctgtaattccagcactttgggaggccgaggaaggtggatcacttgaggtcaggcgtttgagaccagcctggccaacatggtgaaaccccatctctactaaaaatacaaaaattatccaggtgtggcggtggacgcctgtaatcccagctactcgggaggctgaggtaggagaattgcttgaacccaggaggcagaggttgtagtgagccaatatcacgccattgcactccagcctgggcaacaagagcgaaactccatctcaaaaaataaaataataaataaaatataaaatacagttccagataaatggatcttttgtgtgtggtgtgtaagtatatccccaatgttgcgtgggctagacttatactaaaagaattctgtgttaaccagaactccagtttcactgggcatcctgtactgtgtctggaagcctccctcagagacaaagtcacttgccatgggtcacccagcaggttgttagagcctgggatggggaaactgaggtcacagggttgcaggaggtggggggtgagcgtgggaagaggtaaaccatgtctgcagcagagtctgacccctcgacttctctccctttttctctctccctctttctgtcgccactgggccactcagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagagcgagtggtttaagtgcctgattaccaccacccgcccccccctttgtccagctgggacacggaatggccgcgggcctcctccccctcccctccagcctctccaccagcccctccagtcaaccctcatcgccgtgcccccccagagctagagagatggggcccctgcgtggcccgaggggcagagctgggcgtcacttcgcaagcgtcctgccctgccggggcgcgggggtgggctctggggaagccggtgcgccccccacgcctccgctgccagtgccttacattctggagcgacccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtagggggcctcccatctgctaagcgtttttccgttgagccgctccaaaaacactaagctggggacgccaggtgcccccccaccccggctccctggccctatccacacctccacccccaccccaggatcgccatctttaggggaggcctgggagggggtgttaggtgttttagggccaccgagctcaaacacaaggacccctccccggcccacccagcccagccccaactgacctccatgcctagggaaaaactccccccaccactgccccctcccccgacccaggccaaagccagggcaggtctccgggtctcacctgctcctagcctcacccccctgcccccgaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggccagccgggctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatctaaaaaaaaaaaaaaaaaaaaaaaaggaagaaaaaccacgctaaaaatcaagccactgaaaacaattgcccccaggtctacccagcccctggctgtccttggtcctgtctcccctcctgctgtattcaggggtgccccctggtgctcagcctctaccacccccaaccctgctcttgggtacccagaggggtcatttctgaatcccttgcccagaggacagacctccggggcccatcttggccctgggaaagggctctcctctctgattggtccctaggccacgggccggcccccagacaccattcaccgacccactgcaggctgtcctccaaccatggggtggccactccacccgcagccagactccccgctccccacttttcatgcaggctggcatacccctggctcagggtcaaatgctgttccacacccacctcagaggcaccccctctcccctgccccgtgcatccccacccttcttgccaaaggacctcttttcccctatccagagaccaccccaggtggcattctctcccaccttctcctttgtcccccatcccctgtctctgtcttccagctgtgaatatgaagggtatcctgtatgaaacaaaaacaaaacctgatatatgcaatatctgtctgtctgtctgtacccatgggcctggctcagccattggaggcccagccgagggtccggcagggcacagggacagccaggtggcaccgagtcacaggctgtggtccggtggctgagcatgctgttgtcttgtccttgattttattttcttttgttctttttttttttcttttctttttgtttttaactccagcttcctttgctttttacttgaccaaagctaagacaatagccagatggttagtggggcagccaggcagggaggacccagggctgggattctccaaccttaggccattcctgcagccctcaccacctccagcccctccaagcatctcgtgtagggacccacgcagatggtcccattcattcactattgcccccaaccccgggattttgggtggtctccacagccaccatcatacactcatcccgtgttttcttccaaaaagtcacctcagcagcctccccaggcgatacagagggagagcccagaccaccacagctggccacgacattgcccttaagtaatatgcattggccagagagcccgggctggctgtgcacagcattcatgtagctgatttctagctttttttttttttctgccccactcctgagcaaatctgtcttgccaaggaactaggagcaaccggaggcaaagggagtgggtggccccatcactattgggaccatcgcgtccctgcacagcccacacccgggggcccagagtcctgggctggacgccacccttctcaccccgagcttgcctccttggctcacttggcaccttggctgagtacagcaggcaaaagcccataccaggcagcatgttgtggatggtttagttctccccgcctccctgtttcttggaaaagctacagggtccctgtagggcaaaattcccaggcgccttgctgcagacagagtaagacaaaaacaccaggaagcaggattccgtgcccatctctgcagtttgggttcacaaaagggggtgccgtcatccctgggtggaggagggagtgttggttttttgtttttgtttttttaacatgtatgaaactgacatcttctcaaatcttgttccacccccctctggaagcccccatcacccacccctgctatggacaccacacctatgccaggcccccccccccaccccagtctcattctggggtctgcccatgctgtgggaaagaatagggaggcctcccaaatatatgcaaattgtccccattccgtgggggcacctgacaatgacccgggtggagatggggcatggaggagtaggaagacccagccctatttgactggggagaggaggatctggagtccttcatgcccaggtctggaacccaggttctgaccccagggccccaccctgggctggacaatcagatcccaaaggaatgccaaaggggactcggttgggagagccgcttaggggccagacctgggtccccctgcaggtccccaggcagcagacaattccaccttccctgccccaggaccttgagagacagcagcattccaggcacagacagacttggctgcaccccactgtcccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccctgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattatgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaacaaaaaaaaaagaaaaaagaaaaaaatgtataaaaattaaacaagctatgcttcgactctt

SEQ ID NO: 829 - DNA, 102652 bp, Homo sapiens; identical to SEQ ID NO: 827

SEQ ID NO: 830 - DNA, 109656 bp, Homo sapiens; identical to SEQ ID NO: 828

SEQ ID NO: 831 - DNA, 102652 bp, Homo sapiens; identical to SEQ ID NO: 827

SEQ ID NO: 832 - DNA, 419702 bp, Homo sapiens
ctgcataacactgacatttttattagaattcatttgtaacaaatggaacttgtgtcagcaaagaactgattttcatacagacttctttcgccaccaatgtaacgaagtaagaaaataaaaagcacgcctttcattctgtaaaacatttacgcgtactactaattagaggtaattgtattttttaacaagccattttacaagttatttgttttaatttttcagtctatgcatccaaaacgagagcaaagaacacaactgttattatctttgtaaagacactccaagctgggatggcaaagccacataacggatggatagaatggatctgtagccttctgatctctgctggagtatcagggcacccataaacccaaaaggaaccaaaacccaaaaagaaaaacaaaaagggaattaaaaataaaaggacttaaagcaaaaccgaaaataaacaggaaagaaaaaaaatacgtgcattactgcagacttttttcccttcctgtttctatgttgtgttatttacatacacacaaatgaatttccgaagcagtttcttacagatgggttcaagtaatatcattattgggtgtagaatcaatagggcagtgcatagtacaaaggtatagaaagtgcaaagttccctagaggcccttccctcccctggctgtcctcgccgttttctaaccatgcaaatcatttttaaaaaagagctaaaataaagttctgtacaaatcactttttatatattttgattttttttaccattgtaactaattacaaaattatacataactacacgtacataggtaaataatagcaccgtactggttatgatgatgaaaataactggaaacttgaaagcttgtggtaatggcagataaagatggttcacctgggaaattaaaacttgaatggttgtacagaaaagcacagagtggaatgcacatcaatgacagtaagggagttagttctaggaacagctcctgaacagtaagattcccgcaatagtctccgcctcgttcgtctatggtatgcatcccattcattttcttcttctgattattgtcatctttccctttgccaaatgggcagttattgtttcagggagagaagctgctcattggccaatcattctggtgtgcagtgctccatcggattctacatgtccaacaaggcatgtctggatgatgcaatgtctgtctgaccccctttgtttaactaaaagaaaattatagcactgagtaatctggcacttggataaatctccaaaaagatacaaactaaaagaaaataatgataacagacccacatagtgcacattcttctctggttctgatgtaggttagagagtctcattctgaggtagccttctagatacttttttttagtattatatatattttcttttttttctttttctttgttttttacaaaagtgctcaaatacaatgcttgcaaatgtttggtctcttggatttcactctgctagcaatgggaaaatgtggaaaacaaaaatccttccatgcagaacatccatgaagctaaaattaaaccaaagtagtatactcataccaaaactctttaagagttccttgggtattttgaggattatttaaaatcatgtaatatgtggcaaacttatgccatcatccatggcttcctatagaaattctgttggaagaattgggggtaagatacatatatatatatagtttatttccccttttagaaaaatcctaatggaatatcaaatatattccaaagttgccaatgatatttgttactaaaataagtttggtgcagttactgcatgttccagagcggatttggaagggaatataaataaaacaagtagctttttctgatgttgatgattgattataaaaggaagaagggccctgattatccaagtgctttgggctggtacaatcactaacatccccgacttggctgaaaactaggaatgcatattattcaaagagtttttgtacatgtggtaaacagataatgctttaatagaaagtaacagatacgaacagtgaatggaaatacgaaccaaaagctaaaaagaaatgctattaaaataggcatcaattataaggcactctaaatgcaaaactaaaaccaaaacgaaacaaagtacagcacttcccaggaatgctgtatgccacaaaatgtttctgactgaacagagtaacatgaatttggctttgcccctgttacatatcataaatgcaaatttcatagcacatactatagacaatatacgattgaatacactttttttaaacaactcgatagctgatatattacaacattctcccctcctaaagggatatgcactgacctttcccacatgcacacctcttagctatttaataataatttttattgcactagagtgttagaaatattgaactttgttggaagcctgactaacaaacaaacaaaacaatttgtggatgtgattgattggttaggtgggggtagattaggtaggaaatcagggggtgaggtttgacaatcaatcactgatgtgcattcctcatttccctttaaagaaataccaatatgtcaaaaaattaagaataaatggaaagagatgtttacaatagcttttctacgtttaaaaaaactaaatcatggaagaactgactgactgataactgtatctattttttgtgtggacacactgtctatatatacatagacacccttataaaatatggatatatatgtatatatgttagcagcaactttatactttgcgcctccctgttgattccaaaaacaaaacaaaataataattatctttgattatttgaagagaatgggtactttctcaccaatcaaaactgaagtgtaaaattaatatatctgacgagactgatactgtagattgagttttgcacaaaaatgtgcaaattttcaaatgatttgatatttctacagcaagatattacagataacagttctacagcttaaaaaaacctacgatttggaaataaaaaaatgaagagttatgtaacttttttaaaattcactttatcgaatgatacattttgttaaaaaaaagtttacacagttagaaatgaagcacaggtcagcagtatctttacaatactaaaaaactaaatcaaggactttctttttaaacattccctcccctttccccctaaaatgttattatgagcagtatggtgggaaggggcgatgtcaaagcagagtccgtttcattgtgagaagccacaccagcacatatcttgtgctgaactgcagcattctggcaatttctccttgcacctttcaagcaatcctgaataagatggtggttctttgctgtgatttcttcttcccttgattttgaatccttgaggtatctgtaaataaaatccttcagatgcctcatcagtcaggattctcttcattatttttcaggttagattattaaactgtgaattcttggtccacctggaataatttgtttttaatttgttttgtgtgtaatagtcccactaagtagttgttagctagaagttaagaaggacttctcaagtgccctgtatggctcagaagagactccatggatattgaagggcctgtagtaaaaatccagaatgggtcaggggtttctacgttgcatagtggtcaaagctgcccaggtactctagtgcggcacgataggaaaactgatattgatcctgcaggagacaatgaatggggagaagcaaaagaagggaccatgagcatattttaatagaaaaataaaaatcaatattgcataacaaaataacatctatataggggcaaaatcactactttcgtcaactggtctaatccaatgaccaattgtttatagtgaacaaagaaaaagccacatggggtgttgattaactttgccaatcaatttgactaaaacgatctcccaattccaagcagtggcaggtcgagtgaacattaccttcccagacaagtgttttccaagtagtatcaaaccattaccaccaattgaacacataaacttcttacatgccttataagcagataatgatgaaaatcatcctttacaattatctgcttattcaagataactaattctcagtttaaatatttaagagaggctgatacagacacaaactgtcctgagaaaaatctgaatttacttatcttctgaactactgccaacagaatttgaatttttaaaaaattatgtttggacagtagagcttgcagtgagaatcactcacagtcatttcagctaccctttggctgtctctctcacttacatatgatgttcatatacagccagaaggtagctggtgcggcacaccaggcacacaaatccatttacacagggcactggacttccaagctttccatccctgaaaatggcttcacaggactggctgcccacatcaaaaaatacctgtaaattcagcccaattctgtgtgattgctagttgtctgttttagagaggcacacactaaaaaaaagcagtatgaagcatggcctttttcagacaacgaagaacactatcatattggaataaattgaagcattgttggagagatggaaaaatcacaatttacagctctctatagggatgaggaaaaggattttccccataaaagaaacctattttcagtggccaatcgggctgaaagtagacagatagtttctattttgcttaaatgtgcatttttctgtaataaaaatggttggtaatgcaaaataaatggtgtttactttcctatcttgtcacagtaagttgcttggctgagtgttaaggctttttaaatgtccaatttccctctgtaacccctaagacccattaagtttgtcaagctggcataatgttttgactattgcaagccaaacacttgcactactttgaaatccgtctgaaagatactgtggatgatgaattgaggaacacatataagttgtataatttggtggccttttgcagaacataaactctatcagtaatattatctttagaaatgaatgctcaatagaccagactggctatatcataaactcttattattacgagaaatatccaaatttccatattaattattggaataggaaatgaggggctaatattaatatctctaggcttatccagaatcaaaatgttttgaatggccattgttaagacatgaaatatagaagagctgatacctctgtaggcatacagagggagaatggagaagttaaatgggctgagattatattatgtactaaatattatgctttctatatatttatatatttatattataggactatgaatataacgaattttatgaaattgccattttattggtcaaaaatggtccagtagtaaaatttaacatagctcaatctaacatataatctcacataatttctatagcaacactaagacactaataatctcatcccatttaaaaagggggaaaatgaggttcaaaattattaaacagtttgatgctttccccacagtattttgtgtctggtgttgagagagtatggagtccgggaggtccaggctagcaaaacgtaggctcttgagatgcgaaaaatgcaatggattttctcacctctgtctgtaccatagctggtcgttgtgttcttaacattttgacagtctggaagatatctacaactccttcatatctcattctttccaaaacaatgcttagcgttatgaagactccagttcttccaacgcccgcgctgccacaataacaaaggcgatgttactgggtgagatgttcacagtcttggccacatttgcttgggtgtggacatacttctaccagcttccacactccgtatctctttatagccatattcaggaaaacatggtatcacattcatcaaatgattactcttgggatactgagttgtaacagcatgtgataatgaggatgaagtaattaggagtaagtctaataaaaggtcttttcaatggggatttataccattttagaaagaccaaggaaacataacaaatgaaaagaaagggtaaataacatataggtttataatattcatggagattctgaaatttacaacctgcctacttaatatttttaaagtatgaaataattcagaataaggtgaagtgaatttggcatcttcaacttttctatcacactgttcacattttgcagttacttaaaatacatatgcgatgcccataacctaaatgtatttgcctataactagtcaaatgtttacactggttttattatgagaaaagagatggtataacagggtatatacgtgattttcacttagtcttcaggagggtttatgactatcctgtaagtgtacgtacacatgaagtaaatactatgttgttttcttatttcttgagacttagaactttcaacagattctcacaggggtctctaatcttaaaaaaaaatggttaagagccattgatctctgaacttagctaccatttttacatgatcagcaactaaaaccacattagaaaggttttgagtttctctctgttgtcttcattgttttaagataactccagaatcttcacggtagcaagaaagaaaattaattcatagctcttgtgcacttaaggaggaaagcaatgggaagttcagataatgagggaaacagtgaataatctgaaaaatccctgcatttttggatcctaattaaacagcatgtgtaacacttgggcacgggctgtagaaaatagatggattcatttactggagggtgtagctgacaggcatatataaatagtgtgtccctttataaatggggtttctacagtctaaacagaaatgttaagtgaggtttgaaaatccaagcggagtcagtctttaagaagtgattgaagatgtctagcggcagtgaaaccttctgttaagatgaagcagatgaccttgaaggtcccttttaaccttgaaagtctctcttagttgtgagaaactgagatttattatctttttgttgaatgatctaggtactccagagtctatcttaccttgccagagtctatcttaccttgatttgatagctcgaatgcaacaaaaacattgggttactttctactaagtattttcaaaaaaagaacagacattggactcacaacttttcaatttactggttttatcatcttactttaataagttataaataagaaaagtggtattttcagaacattcctaaataagaggaaatatatagaagtcttctttgtgtgtgtgtgtgtgtgtgtgtgtgtatatatatatatatatatatatatatatatatatatataaaaggtatatgcatcgcaattcctttagcattatactaaaggaatattaaaattattttatgacaaaaacaatgagaacaggcacacataacacatttatgtacctatacatataaggatgcctaaagttaagaagatgtattaaattaaagatactcttttccttagagattattttagaaaagtttaaattagcatttgggcaaattatgagtaaagataaaagaaatatccaggtaattcaatcccaatatataccatctactttgtctgaatatgggtatacactgttttattgtgctatactttatggagttttgcagatactgtgtttttcacaaattgaacgtctgtgtcaatcttgcattgaacaagtatattggtgccatttttccaccagcacatacttggtttgtgtctctgtgtagcagtttggtaattcttgtaatatttcaaattttttcatactattacatctgttaaagtgatctgtgatcactgatctttgatgttactactgcaattggtttggggtgccatgaaccatgaccataagacaacaaacacttaattgacaaatgtgtgtgttatgactgcttcaccaaccagcagtttccccatctgtctttttctcctcaggcctccctattccttgagacacaacaatatcgaaattaggccagttaataaccctacaatggcctctaagtgttcaagtgaaagggagagtcgcgtgtatctaactaactttaaatcacaaactagaaataattaagcttaaagcccagatgtgctgaaagctaggcctctcgcaccaaacagcctagttgtgaatgcaaagttcctgaaggaaattaaaagtgctactccagtgaacacatgaatgataaggaagtagaacagctttactgctgatatgaagaaagttttaaaggcctgcatagaagatcaaatcatttacaacattcccttaaatcaaagcctaggccagagcaaggccctaactctcttcaattctatgaaggctgggaggtgaggaggctgcagaagaaaagtttgaagttagcacaggttggcttatgaggtttaaggaaggaagccaaccccataacataaaagtgcaaggtgaagcaataagtgctgttacagaagctgtagcaagttatccagaatatctagctaagatcattgatgaaggtggctacattaaaaaagagatcttcaatgtagacaaacatcattatattggaagaagttgtcatctaagactttgatagctacagaggaggagtcaatgcctgacttcagaacttcaaagaacaggctgactctcttgttaggggctcatgcagctggtgacattaagctgaagccaaagctcatttaccatttgaaaatcctagggctctcaagaattacactaaatatactcaagtgaaaggaagagttatacatctctcattttaagtcaaaagcttgaaaaaattaagttttagtaaggaaggcacgttgaacatcaagacaggctgaaagctcgacctcttgtaccaaatagcccagttctataaatggaacaagaaagaatggatgataagacatccgtttatagcatggttgactgaacattttaaggccactcttgagacctactgcttagaataaaagattcttttcaagataatactgctcattgacaacataccttgttacccaagagctctggtggaatgtacaaggagattaatgttctcatgcctgtgaacacaatattgattctgcagcccaatggatcaaggaggaatttcaactttaaagttttgttatttaagaactacattttataaggctatacattctatagatagatagtgatttctctgataggtctgggcaaagtaaattgaaaatttactggaagtaattcaccattctatatgccattaaaaacatttgtgattcacgggagaagatcaaattatcaacagtaacaggagtttggaagaagttgattccaatcttcatggatgactttgaggggttcaagacttcagtagaggaagaaattgcaaaaatggtggaatagcaagataactagaactagaagtggagccaggagatgggactgaactgctgcaatctcatgataaaacctgaatacatgaggagttgttccttacggatgagcaaagaaagtggcttctcaagatggaatatactcatgaagatgctgtgaacactgtggaaatgacaacaaaggatttagaatagtacataaacaaagttaatagaaaagcagcagggttgcagaggaatgactccaattttgaaagaagttctactgtgagtaaaatgctatcaaacaacattgcatggtgcagagaaggctcttgactttgtcacttagtcacttgatgtggcaaacttcattattattttcttttaagaaattgctacagccacctcacccttcagaaaccaccgcccatcgattagtcagcagccatcaaaatagaggcaagaccctcaaccagcaaaaagattaaaacttaccggaggctcagatgatgattagcatttttttttttttttaaactttaagttctggggtagatgagaaaaaagtgctggtttgttacataggtataaatgcaccagggtggtttactgcacccatcaacccatcatctacattaggtatatctcctgatgctatccctcccccaggcccccaccccctggcaggccctggtgtgtgatgttcgcttccctgcgtccacgtgttctcactattccactcccacttataagtgagaatatgcggcgtttgattttctgttcctgtgttagtttgctgagaatgatggtttccagcttcatccatgtccctgcaaaggacatgaactcatccttttttatggctgcacagtattccatggtgtatatgtgccgcattttctttatccaatctatcattgatggacatttgggttgcttacaagtctttgctattgtgaatagtgccacaataaacatatgtgtgcatgtgtctttgtagtagaatgatttacaatcctttgggtatacactcagtaatgggattgctgggtcaaatggtatttctggttctagatccttgaggaatcaccaaactgtcttccacactggtttaactaatttacacacccaccaacagtgtaaaagcattcctatttctccacatcctccccagcatctgttgtttcctgactttttaatgatcgacattctaattggtgtaagatggtatctcattgtggttttgatttgcatttctctaatgaccagtgatagtgagcattttttcatatgtttgtctgccgcatcagtgtcttcttttgagaagtgtctgttcatatccttcgcccactttttgatgaggttgttgttttcctgtaaatttgtttaagttctttgtagattctggatattagccctttgtcagatggatagatagcaaaaatttcctcccattctgtaggttgcctgttcactctgatggtagttttttatgctgtgcagaagctctttagtttaattagatcccatttgccacttttggctttagttgccattgcttttggtgttttagtcctgaagtctttgtgtatacctatgtcctgaatggtattgcctaggttttcttctaggggttttcatcattttacatcttaggtttaagtctttaatccatcttgagttaatttttgtataaggaagggatccagtctcagttttctgcatatggccagccagttttcccaacaccatttattaaatagaggagcctttccccattcttgttttccctcaggtttgtcaaagataagatgtttgcagatgtgtggtgttacttctgaggcctctgttctgttccattggtctatatctctgttttggtaccagtaccatgctgttttggttactgtagccttgtttgaagtcaggtagcatgatctctcaagccttgttctttttgcttaggattgtcttggctttgtgggctcttttttggttccatgtcaaatttaaagtagttttttcccattctgtgaagaaagtcattggtagcttgatggggatggcattgaatctataaattaccttgggcagtatggccattttcacgatattgattcttcctatccgtgagcatggaatgttcttccatttgtgtcctctcttgtttcattgaacagtggtttgtagttctccttgaagaggtccttcacattccttgttaagttggactcctaggtattttatcttttttgaagcaattgtgaatgggagttcactcgtgatttggctattattggtgtataggaatgcttgtgatttttgcacattgattttgtatcctgagactttcctgaagttgcttatcagcttaaggagattttgggatgagatgatggggttttctaaatatacaatgttgtcatgtgcaaacagagacaatttgacttccactttttctaattgaataacatttatttctttctgttgcctgactgccttggccagaacttccaatactgtgttgaataggagcagtgagagagggcatccctctcttgtgctacttttcaaagggagtgcttccagtttttgcccattctgtaggatagtggctgtgcgtttgtcataaatagctcttcttcttttgagatacgttccatcagtacctagttttttgagagttgttagcataaagggctcatgaattttgccaaaggccttttctgcatctattgagataatcatgtggtttttgtcattggctctgtgtatgtgatggattacgttcattgatttgtgtatgttgaacaagccttgcatcccagggatgaagccgacttgatcgtggtggataagctttttgatgtgctgctggattcggtttgccagtattttattgaggattttggcatcgatgttcatcagggatattggcctggaattttcttttttgttgtgtctctgccaggttttggtatcaggatgatgctggcctcataaaatgagttaggaaggagtccctctttttgtattgtttgcaatagtttcagaaggaatggtaccaattcctctttgtacctctggtagaattcgtctggtcctggactttttttggttgctaggctattaattactgcctcaatttcagaacttgttattggtctatgcagagattcaacttcttcctggtttagtcttgggagggtgtacgtctccaggaatttatccatttcttctagattttctagtttatttgcatagaggtgttgatagtattctctgatggtagtttgtatttgtgtgggatcagtggtgatttcccctttgtccttttttattgtgtctgtttgagtcttctgtcttttctatctattttgttgatcttttccaaaagccagctcctggattcattgattttttgaagggtttttcgtgtctctatctccttcagttctgtagtgttcttagttatttcttgtcttctgttagcttttgaatttgtttgctcttgttactctagttcaattgtgatgttagggtgtcgattttagatctttcctgctttctcttgtgggcatttagtgctataaatttctctctacacactgctttaaatgtgtcccagagattctggtacattgtgtctttgttctcattggcttcaaagaacatctttatttctgccttcattctgttatttacccagtagtcattcaggagcaggttgttcagcttccatgtagttgtgtggttttgagtggtttttttttttaaatcttgagttctaatttgattgcactgtggtctgagagactgtttgttatgatttctgttcttttgcatttgctgaggagtgttttacttccaatatgtggtcaatgttagaataagtgcaatttggtgctgagaagaatgtataattctgttgatttgggtggagagttctgtagatgtgtattattaggtctgcttggtccagagctgtgttcaagtcctgaatgtccttgctaatgttctatctcattgatctgtctaatattgacagtggggtgttaaagtctcccactattattgtgtgggagtctaagtctctttgtaggtctctaagaacttgctttatgaatctgcatgctcctgtagagggttcatatatatttaggatacttagctcttcttattgcattgacctctgtacgtaatgcccttctttgttggtttaaagtccgttttatcagagactaggattgtatcccctgctttgttttgctttccatttgcttggtaaatattcctccatccctttattttgagcctatgtgtgtctttgcatgtgagatgggtctcctgaatacagcacactgatgggtcttcactcctctttatccaattggccagtgtgtgtcttttaattgggggcatttagcctatttacatttaaggttaataaggttatgtgtgaatttgatcctgtcattatgatgtttgctggttatttgactattaattgatgcagtttcttcccagcatcgatggtctttacaatttggtgtgtttttgcagtggctggtaccagttgttcctttccatgtttagtgcttccttcaggagctcttgtaaggcaggcctggtggtgacaaaatctctcagcatttgcttgtctgaaaaggattttatttctccttcacttatgaagcttagtttggctggatatgaaattctgggttgaaaagtcttttctttaggaatgttgaatattggccccactgtcttctggcttgtagggttgctgtcgagagacctgctgttagtctgatgtgcttccctttgtgggcacgccgacatttgtctctggctgcccttaacattttttccttcgtttcaagcttggtgaatctgatgattcattgtgtgtcttggggttgctcttctcgaagaatatcttagtggtgttctcagtatttcctgaatttgaatgttggcctgtcttgctaggttggggaagttcttctggataatatcctgatatcctgaagagttttctccaacttggttccattctccccttcactttcaggtaaaccaatcaaagtaaatttggtgttttcatatagtcccatatttctcggaggctttgttcatttctttttactcttttctctaatcttgtcttcatgctttatttcattgagttgatcttcaatctcggacatccgttcttccacttgattgatttggctattgatacttgcgtatgcttcacgaagatcttgtgctgtgtttttcagctccatcaggtcatttatgtttttctctaaactgcttattctagttagcaattcctctaaccttttttccaggtacttagcttccttgcattaaattagtaacatggtcccttagctcggaggagtttgttattacccacgttctgaagctgacatctgtcaatttatcaaactcattctctgtcctgttttgttcccttgctggcgaggagttgtgatcctttggaggagaagaggcgtgctggtttttggaatgttcagcctttttgtgctggtttctccccatcttcgtggatttatctacctttgacctttgatgatggtgaccttcagatggggtctctgggtggacgtgctattcctttctgtctgtctgtttgttattttccttctaacaaacacccaggcctctctgctgtaggtttgctggaggtctattccagacgctgtttgcctgggtattatcagcagaggcttcagaacagcaaagattgctgcctattccttcctctggaagcttcatcccagaggagcacctgccagatgccagccagtgttctcctgtatgaggtatctgtcagcccctactgtgaggtgtcacccagtcaggatacatgggggtcagggacccacttgaggagagagtctgtcccttatcagagctcgaacactgcactgggagaaatgctgcgctcatcagagctgccaggtggggatgtttacgtctgctgaagctgtgcccacagctgccccttccgccaggtgctttgtcccagtgagatgggggttttatctgtaagtaagtctgtgattggggctgctgtctttctttcagagatgccctgcccagggaggagtaatccagagaagcagttggccttgctgagctgcagtggactcagccctgtttgaacttcctgctggctttgtttacactgtgagggtaaaacaaacagcctactctagcctcagcaatggcagatgcctctcccctcacgaagctcgaatggcccaggtggacctcagacagctgtactcgcagtgagattttcaagccagtggatcgtatcttgctgggctctgtgggagtggatcgtatcttgctgggctctgtgggggtgggacacaccaagccaggcactggagggaatctcctggtttaccagttgtgaagactgcgggagaagtgcagtatctgggccagagtgtactgttcctcgtggtacagtctctcacggcttcccttggctaggaaagggaaatcccctgaccccttgtgcttcctgggtgaggcaacgccacaccctgctttagctcaccctttgtgggctgcacccactgtccaaccagtcccaatgagatgaaatgggaaacgcagaaatcccctgccttctgtgtcaatctcactgggaacagcagaccagagctattcctattcagccatctttccagctcttgtaagtacattgttgtttgtttagacctaatgctattgcacactaaatagactatagtataaagtaaacacaacttttatatgcactgggaaaccaaaaagtatgtgtgactccctttattgtggtaatctggaactaaactcccataacgtctctgaggtatgcctgtatttgattccatgtgtcatttcctacaagctctttggttggtttgcaaaggatgtttaataactcaatagaaagtagaaagcaaatgtacatagataaaggtttgcttcttataacatgcctgagaaacaaaggatgctagaagggactttaaacctcagctaagataactgaagtccagagaaacttcattatcatagagccaaataatagaattgagattagaacacagctatcttagcccaagtctaatatttgtcctattttgagatcctgccttctatgtcgtaaagaactatagttttctttgatgtgctgaagcaaaatatattttttaataaactctctcaagagtttcaccataaaaagattagatgtcaagttgccagaaccctaaaatatattagtttaaataaaattagatgaattgcttttgttagaaggtttttgcatagcaacttccaaaaacactaaatttatggtgaatgtctgaactatttacttgctatttatttctattaacttcaatgacttgagttataaaatgctctagaaactattgaaaataattaacttgaaggtgcttcattttctgatatagcaacaattttcaagcaaattgcattttttaactgaggtaccatactaagcacttattgactggcagaacttaatattgtcattaggatttatttgatagctattcatgaggttttcacaaacagaagaaagacagttatcagtgcattgctatgaaagcaaaagcaaatatgaaatgattaacaacgaattattactaggggaggtaccaacaattcccattaaggtaaaattggtaatttggtttgtctaataggaagcaaattttttgggggataaacatttttttggggctaaacattttcctctgattattttcacttattttcactttatgaaaagaaagagaaatcaatcctgctttaagttttgtaatacattgccaagaataaaatttcaaataagcaaacttactacaaaaagtgtatacagacaatgaagaaacaccaccacttatcactgctttattcacaaatggaaacttacctgcaatggactgaaatgggtccatcttggccaaactgttcttttgttttatggacttggccgatgaagtcaataaatccttctccggactttggcactccttgctctggccagtcagtgaactggaactgccttactgttcgggactggccgtcctttagaaggaaagccacatacccggccgcaaaggaagacgccaggaggattcagcaagcatacggaccacaagaacaatcattttcatttcccgaaaacaaaaagggtagaaaaagttaggaacatgtttaaatagaaacttagttatggtttatctgctataaatattgtccacactcacatacctttaaatcctaaatttatttactcttgaaatcctaaatttatttactcttgcagtgcccagttaaaaacctggttctcgttagtagccatccacatagttcccccattaacaaatgtttctgagacccaaagtgggggttcgtaaccattcatcatgtctgcattccttccaaaatggaacatataaaatggaacatatatattccatttcaaaaatttcagaaactaattactttgtaataaatattgaaacaagcacctaggcatgtcatccagaccagagcttttgcagttgtcgcaataacttcacatctgctgtgcttgcgtatttctaccgttgtcaaatgacaaatggtgaaatttaaagtatctgacacaaacccggtagttgctgttaacctggatgccccccatgtctcagaggaataccatttctagccatggcaggggacatagcatgaaccatatgactgtgctgttaagtgggaagtaaagcatccctcaaggataccaacgactattagcaaacaaatgcccttttctgaaaaagagctctccctggctgaccacaggaattaacagtctgtggagagctttaacatagataaaccaaaaggtagaaaaaaaagccagattgaagagcagtctttcttttttagagtgattaggtaaaactgctctgactcacgaagtatatctgggttgaaaagaagacactaaggcatttctgatcttctgatcccttgtggaaatttaaggtgtttctagaagtacaagaaaagtggaagggagcctctgtttatagaagcagaaataatacattgcccatcaaccttctcccctgactcatcagcagagagaaataatccaagcttagagagaccgatctcatttctcatttgaagaggtcctactcctaaatggtctcttctcattaaagagccttcaacttgttcctccattgtttctgttaacacattatttcctcatcaaactttttttagatacacgtgtgcatgttcccaaggttctgggtaagtgaacagggactcaatcctttatcattcactcatattgagaagagagaggatctcagtgtgagatgagcactcatcacctcgcctggtggttttcacagggacatgccagattcctgactgatgttatttggggatggagataaacaggaagatgacaccaagtgtgtgggaatactgagaaatagagaaaactatttggccccataagtactttatggatggttaccatggaagcatgatttacttccctctgtttctggaaaagatttggaaagcacaggaaggagacccagaagctaggtaatacagatttattctcctctgaatgtcctggggatttcatttctgaccacagttgctttcaatagcaagaagaggtcatgtgtgcaaataccttctatttggaggagagactgcctgacttcatttaaaggttacctgtttaacaatactgtaattttcaacccagaattgcatatccagccaaattaagcttcataagcaaaggagaaataaaatcctttacagaaaagcaaatgctgagagattatgtcaccaccaggcctgccttacaagagctcctgaaggaagcactaaacatggaaaggaacaactggtaccagccactgcaaaaacataccaaattgtaaagaccatcaacgctatgaagaagctgcataattaatgggcaaaataaccagccagcatcataatgacagaatcaaatttgcatataacaatattaaccttaaatgtacatggactaaatgccccaattaaaagacacggactggccaattggataaagagtaaagacccatctcacacgcagagatacacataggctcaacataaagggatggaggaagatctaccaagcaaatggaaggcaaaaaaaaagagcaggggttgcaatcctagtctctgataaaactgatgactttaaaccaacaaagatcaaaagagacaaagaaggccattacataatggcaaagggatcaatgaacgaagaagagttaactatcctaaatatatgtgaccccaatacaggagcacccagattcataaaataaagcaagttcttagatacctacaaagagacttagactcccacacaataataataggagactttaacaccccactgtcaatattagatcaatgacacagaatattagcaaggacattcaggacttgaagtcagctctggactaagcagacctaatagacatctacagaactctccaccccaaatcaagagaatatatattctcaacaccacattgcacttattctaacattgaccacataattggaagtaaaacactcctcagcaaatgcaaaagaaagaatggaaatcataacaaacggtctctcagaccacagtgcaatcaaattagaactcaagattaaaaaaaaaaccactcaaaaccacacaactacatggaagctgaaccacctgctcctgaatgactactgggtaaataacagaatgaaggcagaaataaagatgttctttgaagccaatgagaacaaagacacaatgtaccagaatctctgggacacatttaaagcagtgtgtagagagaaatttatagcactaaatgcccacaagagaaagcaggaaagatctaaaatcgacaccctaacatcacaattgaactagagtaacaagagcaaacaaattcaaaagctaacagaagacaagaaataactaagaacactacagaactgaaggagatagacacacgaaaaacccttcaaaaaatcaatgaatccaggagctggcttttggaaaagatcaacaaaatagatagaaaagacagaagactcaaacagacacaataaaaaaggacaaaggggaaatcaccactgatcccacacaaatacaaactaccatcagagaatactatcaacacctctatgcaaataaactagaaaatctagaagaaatggataaattcctggagacgtacaccctcccaagactaaaccaggaagaagttgaatctctgcatagaccaataacaagttctgaaattgaggcagtaattaatagcctagcaaccaaaaaagtccaggaccagatgaattctaccagaggtacaaagaggagttggtaccattccttctgaaactattccaaacaatacaaaaagagggactccttcctaactcattttatgaggccagcatcatcctgataccaaaacctggcagagacacaacaaaaaagaaaattccaggccaatatccctgatgaacatcgatgccaaaatcctcagtactggcaaaccgaatccagcagcacatcaaaaagcttatccaccacgatcaagtcggcttcatccctgggatgcaaggcttgttcaacatacacaaatcaataaacataatccatcacatacacagaaccaatgacaaaaaccacatgattatctcaatagatgcagaaaaggcctttggcaaaattcaacaccactttgtgctaacaactctcaataaactaggtactgatggaacgtatctcaaaataagaagagctatttatgataaacgcacagccactgtcataacgaatgggcaaaaactggaagcattccctttgaaaactggcacaagacagggatgccctctctcaccactcctattcaacacagtattggaagttctggccagggcaatcaggcaagagaaagaagtaacgggtattcaattaggaaaagaggaagtgaaattgtctctgtttgcagatgacatgattgtatatttagaagaccccattgtctcagccccaaatctcaagctgataagaaacttcagcaaaatctcaggataaagaattaatgtgcaaaagtcacaagcactcctatataccaataacagccaaatcatgagtgaactcccattcacaattgcttcaaagagaataaaatacctaggcatgtgaaggacctcttcaaggagaactgcaaaccactgctcaaggaaataagagaggacacaaatggaagaacattccatgctcacggataggaagaatcaatatcgtgaaaatggccatactgcccaaggtaatttatagattcaatgccatccccatcaagctaccaatgactttcttcacagaatgggaaaaaactactttaaatttgacatggaaccaaaaaagagcccacaaagccaagacaatcctaagcaaaaagaacaaggcttgagagatcatgctacctgacttcaaacaaggctacagtaaccaaaacagcatggtactggtaccaaaacagagatatagaccaatggaacagaacagaggcctcagaagtaacgccacacatctgcaaacatcttatctttgacaaacctgagggaaaacaagaatggggaaaggctcctctatttaataaatggtgttgggaaaactggctggccatatgcagaaaactgagactggatcccttccttatacaaaaattaactcaagatggattaaagacttaaacctaagatgtaaaatgatgaaaacccctagaagaaaacctaggcaataccattcaggacataggtatacacaaagacttcaggactaaaacaccaaaagcaatggcaactaaagccaaaagtgacaaatgggatctaattaaactaaagagcttctgcagagcaaaaaaaaaaaaaaaaaactaccatcagagtgaacaggcaacctacagaatgggaggaaatttttgctatctatccacctgacaaagggctaatatccagaatctacaaagaacttaaacgaatttacaggaaaacaacaacctcatcaaaaagtgggcaaaggatatgaacagacacttctcagaagaagacaccgatgcggcagacaaacatatgaaaaaatgctatcactggtcattagagaaatgcaaatcaaaaccacaatgagataccatcttacaccagttagaatggcgatcattaaaaagtcaggaaacaacagatgctggggaggatgtggagaaataggaatgcttttacactgttggtgggtgtgtaaattagttaaaccactgtggaagacagtttggtgattcctcaaggatctagaaccagaaataccatttgacccagcaatcccattactgagtgtatacccaaaggattataaatcattctactataaagacacatgcacacgtatgtttattgtggcactattcacaatagcaaagacttgtaaccaacccaaatgtccatcaatgatagattggataaagaaaatgtggcacatatacactatggaatattatggtgagtgagtattccataaaaaaggatgagttcatgtcctttgcagggacatggatgaagctggaaaccatcattctcagcaaactaacacaggaacagaaaaccaaacactgcactcaaaagtgggagttgaacaatgagaacacacggacacacggaggggaacatcacacactggggcctgttgcgggtttggagtctaggggaacgatagcattaggagaaatacctaatgtagatgatgggttgatgttgcaccaaaccaccgtggcacatgtataattaaattatgtaacaaacctgcatgttctgcacatgtattcaggacttacactccaggagcacagacaaacagcaaatgtagtagctaagaaaattatacaatcacagggagactttaaaaaaaaaaaggtgagcaacttccggtttcaatcttcttttgtttattgtgatcagatttaagttgtgcatgtgtggaataggaaaggtgtctctgccattggtggggcctggtgccttttctttatcaccaggaatagttggtgagtttactcaaaatgcactttctattttcactcacatacctagcttcaaattctgaaagagcactattttttttttttttaaacggtggggcaggttacactcaagacctagagatttaactgctgccttgaatactgtcaccttcagaatagttaatataactttctgggattaacaggtctgtcacctaggccaaccctcctgctaaccaatttctctttcacttaaggtcaacagccagggccaggctttggggattagcagacaatctccaaacctaagtttggagaaagctgctttccagaaaaaacaatggatcaactaaatagctttaccctggagttttattcaacccacccactgtgacagttccaaacacaaggcaggtctttgaactgacctggtctcccttaagatgtgtttgtaatcatgggttgaaagtggccaaaggcgaagatatcagagtttatgcatagaacatcttacatcagggctgaaccttggactcaacaatccagataagaaatgcaggatgaaaattagccaacaagggtcatgggagcacagctctcatggacagacacattagcacactgaggaataagccatgccaggaatcaaattagaatgtgcaaagcttgtcagatttttctaaagaatgccatttgctctgcggttttaaaatcataccaaattaacctctgggtccatatgacctaaagggctttgcaaaacaacaacatatttagagcctcaagtaatgaagaagtcaaaaaagctccaaagagcatgagctgagaaggtgaatgtaagcacagccaaccaatcagtaaacacttcccagcacgaacactcaccaagtgcatccccaaggttgagctgccagatgttatgtttgaatgaaagccaaactaaggtttgtgagaaagcttgccagacagaggaaaagttactcttacatattaaacataaaaaaaaacgttctccagaatgaatgatttctctttgggacaacagtcaagtggcaagtgcttctcccagagagagagagagagaggtatcttagactacttttcagctaatggttaagagttgaagactgtgccaacttaccctggcatctgtgaccttgaattcccttaggatatactgtggcatgttgtactcagccatgggatctacaacaaagtactggtatcttgcagaccgttctgctggccagtattggtgacatttctcctaaaaggagagaagattaatgttaaactatgcaaagtataaagaacattctgtatattatctatctatctatctaatctatctaatttccttatcccattaataaaatttcaaaattcaaggcaattccaattgcatatgactcatttcctcttagaaaccatgagctcccttcatagggaaaccctttggttcagtatttgcctatggcatccagcacggtctctggcagatagtagctgcttaatatacacgagttgaattgagaattgaatactttcatagggtaagcatcttcatacctacaagttatccaaataattacatcagtccttggacaatgctggccatgacaataacacattgcaccaccacagcatacttgcaccactatggtttggaatgaagagaaccatcagtatggacatagaaagaaacctccgaattgatttgttccaatcttacttgtcaaggaaacgaggggcccagtccattttaatgacttggctaaaccctgcagagtcattggccaaatcagagtaagtcagttactttcctcgtctgatattctttttgttctctccgggggctctacaagttgggctttagctgcacttctatttaatttacacaaagaagacagaaagaaaatatctgaagcaaatacgaaataatgcttacatcaagtcaatctaagaggtatctctaaataatattaggtcatagtggtagagcagtattaatagtagaaaccttaagtatttctaatactattttatgtgtatttcaaaaaaaaacaaaccacttttttcaaaagtggatctgggattaccaggttatatccttagaaaaactatgttgctttccaacactttattcaatgggagtgaaaggtaggcaagtaagaatttgcctcaggaagaaaagaaagtcaagttccttcataagtagaaatgatggcacatcaaactctagcctgtccagaacaaaaggcagtaagaatatgctaaaagaagtccgacataagtcaaacggggacacctgctactcatttgtctccatgcttgtgcttcactggaaacaaatcactagatctttctttaaaacacataaatttaaacacttgatgtggctttacaaatttagaaactaacaaggaatgatggtccggattatgtccagagtgcactgcatttcaaaaaaaatgatctagcacaagagttattgaaacaaagtcttcatttctccacagagtaaatgtcttatgaggagacacacaagggccacacacttactctgcccatttcacgcagcttggtgagcatcacaactatggtggaattgtgttcccagagcatccgccagaagtcttcagtggtctctgccaagggcccctgggtagcgatgtaggctttctgttgtctgaattacagagaatgaaaagaatgtgttaaagtatttagagaacatgcaaaagctcacactggatacataaacatcaacctgctaataaaaaacgaaaacatattattaatgcaattgaggtaaattcctgctaagattaaataatcaaataagagcatttaatacattttggggacttcgcaaactaaattgcttgttaatattatgatgtatgtctttatcattattatttgaattttagcgcaatgctaatagctcaatttcattgtcatacaaattacttaagaaacacttagatgtgcagcttcattttctagaaattattctcacacaatctattaaatttatgaaatatggtacaaaacagattctttattaactacttacatatccaattggcttatgaaagaagagtgcagaaggccagattaaacacttcataactactactcctaactcctatccaaaataacaaaaaaacaaataccaagggactaaatgatgacctatgcagaaagaaaatgtctttgaatggagatgaaatttattctggttattaaactagggcacatgtaaatatcaaggctttggatagtcaggggagcaaaagtagatacctgtatccatcaataaaactggcattgatgtaatcagatccttctactccacggataggctgcaggcatacccttgtggattcatatggcataatattaacaaggcgatttttgaatttattacatggaagattggcactgataaaccttgaggtgtgagcttttgagctggctagacgctgttgaataggaaaaaaaaaaaaggaaaaacccaacaaagatcattttcacctacagtttgaatgcagtgtaccccagatttcccttttagatataaatcttttgtttacttaaagtaaatgactattcaaattgtactgcttttcacatctacctaatcactctctatagcctattggatttctatatattttctgaaagtatagtctctcaagttaggagacataagggctcaagatattgttaggaagcaaagaatagaagaggaaaaggggaggaatacattttataatcatacacctgagggaaaggtcaaatgaatcttgtacttcacaaatttgaaaggttaaagtaaagccacgactcaaagacaaacccagaatgacttgctcctgaataaccacatcacatccaataccataccttaaattcgagctccattcctgtgacattctctcccgtttctatttgtgtcagcttctgaatgtaggcatacaagtttctagctggcacttcggtatttccacaagtcactgcttctaacagtgcatcatggataaagatgtattggtcttctgtttgaaccatatagttcctctgggctctcattaaagttacatggccataaatatctacagttttttcatgctttattctttctaacatggcatctatgacgatgaagcaaccagtccggccaactcccgcactatgaggaaaatagagaagaaaagcccaaataaacctatcagaaaatcaatacataataaaagtatttttattattcttattaactagaccttacatccattacttctactcaaatagctattgggatgactttgtaatactctaaagtcaaaagtattatctaggcaccataatcagaggacagggaacaaaagactgagtaaaattagtttagttttaaaatgtaaaaaatattaaatccataatcactatgttccttgatcatgcaatacaaagtgaacattatttcgaaaacttttgaagtcattatgaaaaaaatacaaacatttagtctgtccatatttagaagatagttttatatattggtccagatctggctaggctatagttcttgcaaactctctcaatctgttttcgtcccatgtacaaaacataaagattgtttttacagtctcaagctaaacctcgcatgcttcctatttatcaaacccttcaggctgaggacatttatgtgtcaagtatggttcaatccaaaatactttctcttcctgatcatgcgggtttatcaggctggtaaacatgtcatcaacaggaataggtatataataggtgtatattaccatcttaggtaacaggcaacagacagcctccttcatttgctacatgctatgtttcctgtcatctgtgtatctatgtgttcatttattgtccatccctcattgatctgtccatttcttcattcaataaacaatgaagtactctgctaagtgaaataggggatacgacataaagatgacttagatgctatctctaaagagctcagagtgtatcgaagggacataatactttatacacagctatttctaaacaagaaagaaaaaggatgtattagttttgtatatgatgtggcatttgaagtaggacttgaaggacaggaaggatgaggaattaaagatgttgtagtatgaacaaaggacggatggctttggtaatcacactgctggctctgggagctacatgtgaaattttcataggtctggcaaggcacctttgcaacgaagataccagaactccaaaacaaatgagttaatgctcaccagggtgcctgtctcaactgaaatggcagtttctgtttggtatcatagtggctgcaaggcagtaagagatcattttttttttaaacaaaataatacctttatttaactgctgaacagtgtatatcaaagctagcttgcatacaggagctctgtggtttacagactgggctaactagctgggaatttgatataaccactactttaaaataggttacttttttatgtcctatgccagagggctcctgaatactgatgccaagaatccaatcccaagtataaacccacaaattgacatgacattgatatatcatgcaaaagccttctgagacagagagtcctacaaatgatagcacataccttagcacagaccaattggcaacctgatgcaaacattaatatagagcaaagtcggcctggtggttccagttccttgagatccatgaagtctcattttatttagttggttctaaagaaacctgttagatggcgagttttccctgacattccccattcctaccctcccaggtggttttaatcatcctctgcctcagatccctggttgccctcaaatacccctttactacaattctaaccaaattatattattaatttagggcagccatccataaacaacagcatacatcttgagagcaggaactgcattaaaaaaaatatttgtgtgccctacacaaagcatgcagtaagtgctcaacagtgtttgtgaaataagtaaacaaattagtgactggcttgagatgcctgcagtaatgagcagcccgtcccggtaaggtaagcctacttaggaagcaggactcttcagaccatgcaaaatcctacatttgacaagggtttggaattatgtaaggagtacccgaggactcctctgcatagtgtttgatcaggaataaagagacaggaaaatcactttaagtagtctctttgctggtctcctgatatgccatcagattgcagttaaaggaacctaagtcagactcaacctggaaaagatttgtctttctgggtttctttcaaactccatgtttggcaggtcctgagactccaagtaacatctttcgttctttctgtgttgtctttctaaattgtcttcattgcagctgtgaatcgtttctcatggacacagttttatgcagttcttcccagtggaaaccacactgtaaaccttagaactgagccctatacatcaagtcaattctagataatggcaggactattttctcaaaatatgcatcagggaccattcaaatgtctggatgatgcatggttctatattctggcagaaagatactacagaatcttgcaaaattggtaggaataactccaactctaaacagtatcaaccttttcataatggtgattttttttttccaaaaaataagggaaaaaaatcaaatacgtgtgagtccaaatcatgaattgtgggatgaaaagaaataacagaggctatgacttgaacaaaacctattttttcccccacaattcaaaatattgttaactgcccaatcctgctattcatatggaagatagggaaggagctgacgtttggaacttaatgtgttaccttcttctaggatgaagaattcttgagggatttaaacattaaataagtgttttcgcttgaagcaagaccttgaggcttaaggtacctcttcagacatcaatggctgtgtgtccttgagaaagacattttaaccccttccttatattcccatatttcttaaatgatagtgacagttaactcttattaacgttaattttctagtgagtctaattatccagtaagtcttaaggctaaattaaaaataccaagtgttttgcaaacataatggaaaaggcagttactttctaggtacaaactccattttaacattcagtctctaaagctgacaatgagaaacaagcaatgtaatgctgggaaaattatgacagaattactttagaaacatttgagatttggcttttaaaatcttgctttcgtctactctctcaagctgctcttcctttcctctgccttctttccaataaatgtgccttatacctgaggagctttctgcgttcacatttatcatcgtggcaaatgagatggcaggcaagggccttcctaccacagtgcttgacacctaagaagcattcagtaaatgttggtttcctttccccttctctgacaacacttgggaactgccctgaagtcctacagtcatgcacgccatacctggatagcagagaagactcaaatgcaggttctgaggtgttaaaatttagcaccctgttcccagcacccccagtgcttcacaatgctttccaccatttaggtcagcagtcattgccaaatatggtgactttcctgtagagcgctcgtctgtgatatttcattggcagcatttgactatccctaatgcaggttcctagaaaagctttctatccttggttttaaggacactagtcaagggagtatgggaaacatcagatactcccttggggttaatggtagcaagggtggagattgtgtcattactccagacacaaaataatccaaaacaggtagtacacgaaatcagcccaaaataattgtatcatgatcctgtatcacggttccattgattctgtaacagggtagaattcctaccacgtttgaaatcgaaatcaaagatgaactctaaatgtcatcttcagaaatctactggcatccgttcagactgtgcctcagtatgtttcgttttgttttttttatttgactccagtgctaattctctacctgcctctctggattcttccatctgtatcaatttcacggattacatatctctgccagtccccaaaatgtagataatgctccaaaagttctgtccttctttctctcagtagtagtctccaaaggattcctaaagtgatgcctttctttttcagcacaagtggagatctatatttcaaactgtcttcaagtttatcaaaaataaagattctaagcttaatcagtatcttctcctttcaaatctgctcctcccactctcaggctctccttgacactcaggtttaaaactgaaaaatcatcttagactctttttgcctcttaccctgcaaaataataaattataaattgttatgtattcaaactccacgattatcttcaactccccatcagtggtgtgctagagctagcaaaagccaatccttacattttcagggattatttgctgaaataaatatattaaaaataaaggtaatatataaaactcattgtttcttaattgtttcaaattattttatgctcttgaggtgaaaacatcatatagagtagtccccttttatctgtggttttgactttctgcaatctcagttatttgcggttaaccacggtctgaaaatattaaatggaaaattccagaaataagttttcaatgacatacttttctgaaaagtgtggtgaaatctcaagccctccctttccatccagcccagggtgtgaatcaatccctttgtccagtgtatccatgctatacaggctgcctgcctgttagtcacttagtagccatctcggttatccgatggactgccctggtattgtagtgtttgtcttcaactaacccttattttacttgatggccccaaagtgcaagagtagtgatctgggcaatttggatatgccaaaaagcagctgcaaagtgcttcctttaagtgaaaaggtgaaagttttcaataaggaaagaaagagaaatcgtatgctgaggttgctaagatctatggtaagaatcaatcctctatatgtacaattgtgaagaaggaaaaagaaattcatgattgttctgctgttgcacctcaaactgcaaaagctacggccacagtatgtgataagcacttagttaagatgaaaaaggcattaaattttgggtgaaatacatgaacagaaacatgccatgactgatggcaagtgagcttggtactctctggggactcaggcatccactggggatgttggatcatatcccctgcggatagagggggactacactaataatgtgctggtgatcgtctctctctagtgacctcatgtttgtagcttgaaatcatccatgggaatatttacaccaaagaaatcaggaaatactactttttttctccccagagagcaggtttttacatatttaccagcacatatgactatgctaaagcatccattcccaccatccagggacaaagaggaagagttcctaactttgttcttccatccatatttgttgtattttcatgactctgtcgcctactattccacaaacatttactgagtgcctaccatgtgctgagacatcgaagaaggaatgagcagaacaaacgtgatctttcctgtcggagcttacagtttagtgggggaatctgacattaaataatcacatgaataaacatctaattacaaatctcaagcggcgctgtgaggcaaatgtgaaggatgctggtagagcacctttgaggaagtgccattgaaactgaaatctgttatgggctgaattgtgtttttcttctcaaaattcatatgttgaaacgctaacccccagtgtgactgtattggacacagggcctttagggaggtaattaaggttacatgaagtcacaaggtgggagctttaatcagataggatggatgtccttgtaagaggaagagacaccagagatctttttctctatgcatacacagaggaaaggccgtgtgacggcacagtgagaaagtagtcatctaaaagccaggaagagaggcctctcctgaaaccaactctgccagcaccttcatcttggacttccagcatcctgaatggtgagaaagtaagtttctgttgtttgagccactcagttcggagtattttgttatggaagccccagcagactaacgcaatacctaaaggtcaagtaactgtttgctaaataaagagggtggaaaagcttttgaaaagatatcctaaaaaaaagtgctagaatagacaacatagcacatttgaataactaacagaaagccatcggctgaaaggcagtgagggaaaaagagggcatgttccacatagttattttccattttagggactggctataacatttttattaaacttataaccacatcagcagcatttatttagaataattctgcctcacatgtttcacagtttatctttctgacatggctcatctattcttgagtttattttgatgcatctattggttggctggaatatgtctttgaataatgctttatataagatatgcatggatgccactttttctgatgccttatatatctgagaaaccctttgtgggtttctttttttctttacatatgaccaacaacttggttttgtgcaggattactgggctccaatattatctcttcaaactctaaatacattgcttcacggtctttgttgtcctttgacaaagtcataggccagtctggtttctggtcttttaatagtaatttttgccccaagtaattgggggttgtttctttaacttggaggttcaaaaatttcatctagatatgctttaggcattgatctcactgttaaaaccgcagggccctcaggtaatattttcattacaagattcttggctgttcctcagcactagttcaaattaaacatgttttatgctttcccacctctgggcgtttgtgacgctggaccttctacctccttctcatctgttgacatgtactttccttcaagattcacctcaactgctgcaccctgaatcaacatttccttttgatttattcctccttggactcttttgacaatttataactattttttcagcaactgccttactttagttttgttttctggttattatccttatgccagttggcgctctcctccagggaaaagacaacagcttcgttgtctctactgtttggcaatttccatgccagggaaattgaaggtgctcaactcgagtgacaaaatttataaaaaaaaaaaatttaaaaaactttaaaaataggaagccctctcccagatcaataacacataggggaacatttccccgaagcccccagcatgggaaaattcctttgatacatgtttacaaagataaagtaatgcttataatttgatgagatgcaaacaacctgtgcttatgcttcactccaattgctgagaaataacaaacctccggcacttatttttccttaagaaattgaatgttgaaaattcagagcttttaaaagtatcccagcctacttttgtttgaatttccaagttcccacagcagcatatatttattttgtttccttctccaatttactctttttttgttcacccatcagtatctgagtgcagtgcacctctcaaaatgaaggattgtacttctaaaagcaaatgcatttttctttgatcctgaaaaactcagctctccattgcagtgataatgacggaaccctatttagtgctgtttgtttttcatcatttcaacagccttcaacttgaaacatgataagaacagcaaaactgataaaccacccttatttttatctgttttctgtcagagtagttgccaagcactgagacagatttttctaaatatctttttaaaaaaggagtgcataaccctgtgcttcaggctgaggccagcacaatttagtacatttattatgttatgttacagaaaattccagcaaaaagagaacggcaagtttaaatggagtctagcattatgttggtctctgttatccctaaagtaaaatcaactttttattttccggtgaggacaactattccactaatgagaatcagaacacaaactctatatttgtttgacttcagcagcaaaccaaattattgctaaactttagtggttttttttttttttttaaatttcagtaagtgatagacgttccagtgtttacaagctgaaagactatgcaatccattaaacaagtatgcctactaggaaattgttattacttcaatattatcattcatccagttacaacatttgttttcaatttctaaaaacatgattgagttagtcccacgagttgaaacgggcttaatgtcccgtgatgtgatacagtagtaatgtgcaaaaagaaaaaattaagaggcatacagggactgttttatgctaaagtcattctggagatgtgtttaaaagttggcttttctgattaatgtggtggagttttaatgctgaccctttcctggtacttcactgatctggcaaagaaagacaatagaattaggatatttcacacatcatttagttgggtgccaagacagtaaaatatggactaaaaaaatcattgtgagcattttgtacatatgtcagcttataatttgattggatatagttcacctatcataatggtatatgaactacaagtatttgacatctatgagaaaagattgagttttacgactcaggtttataagattaattaggtgactcttttaataaaactgtgatgtgactctgatgaggctgccattgtgaaaaccttctttcattctttgataaaaatcaacatttaactttataagcagatactgggcatctctacgatatttggggttcactacaaaaaacagacccacagataggttagtttcttctagcatctcttttacctaggataactagagaaattatattaatttctttgacaaaatattcagctgtctaacttttatatattacaaaattaaaatgaaaaaaaattgaacaaattgtcattgatacgcagtcaaatttgtccatgctattcaacatacactatatccctatactaattaatatatagtagttatagcagttttaaggggtagttttgcaatcttcattaaaatttcaaatgcacatactctttgacccagcacctccaactctagaaatctagcacggaggtctatctacacatatgcacaaagagagtagaaagagattttattgtagcattgttgatgtagcaagttaacttagtaaaacaatcatggctagggaactagttgaataaactatggtatatcaataccatggatgtgatgtagcagttaaaaagaatgaagcgaatccatgtattgaccctctccaaaatagcatctaagacattgtcaagcccacttaaatatattgcagaacaatatatataacataacaccacttacattgttttaaaagtccattcaggattacatatctctatttgtacacatgttaatgcacaaaacatggtctgaaaagatacacaaatcagaatagttctgagaaggatcggtaatggtggcagtacagataaactttcactttagttgaagtatttttttgtagcttttttttttaacaaggataacataataatctaataatggaattaagaagaaatataaagcaatgggtaaaaagttactataataaatatcataattacagttcaataaagagttgaggctccaaagacacagagagaaaagatggaacctaattaactctagctcaggaatactgccttgctcagtgatggactgtcagaagtctgggtgatgttggcagctcctgtgtagcccagacttagtcctgccatctggtgctggcttttaaagagtggatatcagaaagtaaggggatataggagtcattgtagagaggagactgcttggcaaagagtaaaaaaaaaaaaaaaaaaaaaaaaaaaaaatctagagttagggagatgacccagagccatgatcactccagaaaggtaaaatgtagtacacttgagtggtgtcttctgaggataaaggaagttcacatttcatcaacagagaaggggcagaaactaagcacaaagttcccaaactgcctgataaggatccttgtatagaatactgaaagatcagggatgagctaccaggttatatccctttgggtgttttatttttccatgctgggtgaaaaggtaatttcctaaaaaaccaaaactccgtctcgagaaagaaaaaaaaaatccacatgggcctaatctgattttttttttttcaaatatgtagactcaaactaaaatcttccaaagacttctgcatgatcttggctttgtcccaatattatctgctgaacacactccctattattcttaaaatgtgattctcatgataaattagaaggctaatgtgttcgcgtaaagaacacctgaatatgccgcagcaggtctcattttacagatggatagaacaggccattaggcatggatagagcagactcagctggctctgataattggtagttgacttgaatctgaatagaggtcaatcaaatgatgctacggaagtttagagaactatatcattcacacagagattttccttgtaaaccataccagctcactccgtattctaaattctgtttagagtgatacaaaattgcccactttttgaaagaggagacaaccatttaccaggcctgccaagtaaagctgcgtgggttgtatactgctcaacccaaaggaagttacaatcacatggactacgtacaacgtgtgcaacctgctcagtccacacagcaggcttgtcattagaaatataaatgctattactcctgattcaggttaagcaagattcaaagagaggagccactggaaggtacttggagggcatttgaactttagcaactttgattagtttgtaaggcatatcattttcccacacagacaagattttactatgtacacaaatgccaggagttttttggtttttctttttaaaaaatgctattattgcccaggcatggtggctcatgcctgtaatcccagcgctttgggaggctgaggcggacggatcacgaagttaagagattgagaccatcctggccaacatggtgaaaccccgtctctactaaaactacaaaaattagctgggcgtggtggcacatgcctgcagtcccagctactagggaggctgagacaggagaatcgcttgaacccagaaggtggaggctgcagtgagccgagatcacaccactgcactccagcctggcgacagaacaagactccgtctcaaaaaataaataaataaaagaaaaaggctattatcgttatttaaatggtattgtccaatagtttggaaggctctaaatctgtggttccttgtttcattttgtccttttgtttgactcctgcaagcttttataaggcagtgagaatctcactctcaatacaatcagtttatgattgtttgcaacaccctagcaacctccagcaggcctttgtgttggttttgtagaggcctgttatggcttctgatccggcttcttaaactcatgggtttctgaattatgaatcagtatgcctatttatttatttatttatgaatgtatgaatgaatgaatgaatgaatgagatggagtctcactctgctgcccaggaggctggagtgtgctggtgtgatctcggctcatcgtaaactccgtttcctgggttcaagtgattctcctgcctcagcctcctgagtagctgggattactggcacacgccactacacccggctcattttccttatatttagtagagatggggtttcactatgttggccaggctggtctcgaactcctgacttcaggtgatctgcccgcctcagccccccaaagtggtgggattacaggcatgagccactgcacccagccagtactgcccattgcctcttctaacccttttgcctactcacattcgtatacatatacaaatttgagactccttctcaaaaaaaaatatatgtatatatgtatatatgtatatatgtatatatgtgtatatatgtatatatgtatatatgtgtatatatgtatatatgtatatatgtgtatatatgtatatatatgtgtgtgtacatatatatatatatatatatatatatgtttttttttttttgagaaggagtctcactctgttgccaggctggagtgcagtggtgcgatctcagctcactgcaacctccacctcccaggttcaagcaatcatattttttaaatatgtcttttatttattacataataaattgaaatttttaataccttatttatatttatccaaaacttagaagtttaagatcattgctaagtactccttattctttttttcactttttcataacttttctattgtaattataaggtgctagaatccatagttcatcaatgcaaaatgtaaaatgggattcacttccacaaagtcaaacacaagaagtaacagcaaaataaacagaaaaactttatgtaacacattcatccaatgaaataactatctaccatgactggtaatggttgtcctacaagatggacgaaaatttcatgaaataacaccaatacgaaaaatttaaataatagtaatgtttctacttttcaattataaatggctatccacataactgaattttcttctaatctgcttcaagacttaaagaattttctttttctttcctgtactaatcattgaacctcagtttctaataaattttggagcatctgggcctttgaactccttgaataaaggtactgttaaaatactaaggttttcctgtttgttggttggtttgactcaagtagttgcatatatttacaggcttaagaatttgatgaagatcacgtggctgtcactagggagctaagacttgggtccacgtctccccttccaccagactctcacttccaccaatgggagttttactatgaacagatgacagttttccttggagctccccagatggacccaaggtccacgattctatcaatcaatttaggctgtaagaatgttggtccaagagagaaatgctgttcctgtaattgtcttttattcatgaaacattagctctcccactctactgcactactgaaaaataaatgaattaagtggtttttaaagcactgccaaaataggtctttgtgaacctggtgatatagtttggatatgtgtaccctccaaatctcatgttgagatatgatcctcaatggtggaagtggagcctggtgggaagtgtttggagcatgggaggtggatcgttcatgaaggcttggtgccctcacggtggtaatgagggatattgagtttacatgagaactgattgtttaaaatagtgcggcacctctcctgtctctctcttgctcccttttgccatctgatacactggctccccttttgccttccaccaaacttcctggggccctcaacagaagcaaatgccagtatcacgcttgctgtactgcctgccagaacaggttgtaggccaaataaacctcttttcttcagactaacatacctggttatgtatcagctagttacatttatgtcagctctatctcttttagaatattttggtctatggttgaccttttagttcgagtggtatgcatacatactgacgaataaataagagctagtattaagtgtatttagaataacctactggtcatgtttaaggatgacagtagagaggacagggtttgcctctcatgcagaataatactagaagatgggaaacagttaagagactgtgacaccaaagagctgaaggttaatattcaataattcaactcaatggatgcaaaatgggagattcctcttctatgtatcaatcgccatgcagtgtaccccaggcatatatacattatatgttcaagtagtctgaacatgctgctagggactgtgagagcacggagacctgggctctgtcccagaggttcttattcagtaagtctggggtgggaccaaagattgtgcatttccaacaagttctaaagccatgctgatatggctggtcgctgggccacactttgggtaatgaggatacaggcacattgctaacatttttatatgtaaatacagacaaaaaggtgcacagaatacactcataataatgtacatatgtgtgtgtttacatacatacacataaatttaaaaaaatcaaaatctctcattcataaggattttttgtccttagcaatgtaaagttcaatggaaaggagagaccgcaaagggctgctttcaaaaacgcaaagtttgcttttcattttttttaagaccaaatactttactatctccagatacctgaaaatatatggaattatcttgtaataaaactcagatgcccaaagcccaccttttgagttttctttgcaagaaacaaccccaaatgcgagcaaatcagataccatgtaataagacctaaaagtatttttccaaagacagaaagaaaaatatctaagcaatagaacccagattggaaagacaccaaacaaagataacagaactatttttaagcctcattttatgaccaaggggcacagcaaaatagtttgaaatagaaagttttcatgctgattacatgaaatcaaaatacacactgttcaaaggcagccaacattattattttttaaatgcagtctagttcatgcaataagtttcagtgttctttcagtctgggaacatttcaaaatacattgcaggtacagctgggaaaactcagtgatacccctgtccagatctcagctattaggttataaaaatattttcacatttcctgcagatgtctagattcctttctttggtagtaattttaattcagacctcattattgacagctgtttgttctgatagaacttaattgctcttctaccagactcagctgcaggcaggctgatttcctttccttatagagtatattacatataaacacaggcaggaaaaaaataaccaattaactaaatacgtgtgcataaaatgattcattgagagctctgatcaagtaatgtatccaactgcaacataggtcaaaggaaattacagcacttatagtttacagtattaaatataattatatagaaatactcaaaagcactaaaatatatagatgatgagtggcagcatctgaaaatctacttttatcaaagaaatttataaaattactatatttgagtaactggaagggtatttattctgctgacggattaactcatggatatctattttacataagctatacgctacaaagaacctgagatgccttccataactgacaaagtcatgaggaacccagcatgctgtgggatcacactgcaatgccaacaattcttcttcgaagggcagagtttctggggacacaccaactcttttcctcattctccagtcactgctgtggatgagctgcttttcctaactttaccagaaaatgaatacaaattctttgaagttaaagctattccctctgtttgaagacaatgcctcattttagcagctcaccaagagatgcaggaatagcttggcaattttcattctatcaaatgccttggcagcctcactcatggagtctaggcctatttggagaccccaagctgccttccttactggactggaacccctgaagagggataaaccgagggctgaattcatcaaagaacatataagcagcaaatatactgcatttgagacaagcaatagttccttttattggctctgtctgttttggaaatggagagaatgtggtgagcagggaagaacaaactgctccttagtaaggaacccactcaaggaaaatgaagtttttttcttaatactagggacgctatatggtgcatcccttttcggggccaataaatgcttctctttgcagacttaatctacctcatatagggaggaagatattgggaataggatgcttattaccctgataattctcagggatgcagcatacatttccattaatactaggcataatgctaattacaatgcaagccccacactcaacatttacaaaccctgacaaaatgaatgtaagtatcctacagggtttggtatccacaaaatctggtcaatagcctactcccagtccctccctttcccctaagtaacaaaggaaaccaatacttcttggtctttgagagtaattctactaagtcccgtattttttagtctatacatacagatcattatacccttcagattcttgcatggtatgactcctggcatcgttttggattgtgacacttctactctaatgctcactttatttagtgtctgtttcacacatggcatagttctaagggaggatgcaatgtgacctcatagacaccatctccaaccacgtatctctaacggttgaaagttacagcctggggaagaaattcagttttggctcatggaattaaagacttactacactttaaaattccccccatcatttttttttttcttgaaggttcacttcttactggttaaaatagtttaaacataatttaaagtcctgactgagttgatgatactgactattttgttttcaattaagcataacagagcaaatggtctttgatgtgatgtactcattttatgaaagaaccaggctggcaaacaaaaattttatggaatttagagatactaactctggctcttccacctgcagcttgtatcttaaatacatcatttatttattcttccagagcctctgttttctcacctgtaaaatgtaaacctatttcctaagttttctatgatactgtcagcaaaatacattttaaataatagcttcttgatcaatgttaatttcagtactcttttttctatgaattgaggacctagaattgaatattttaattcagttagcctaaccacagagtagatatgcaaccttcctattcttgcatagtttattagacttctactaataaattttatgaaaccaatatttaactttattttctggtttaaatcctctcaggaaaaaaaaatgtaatataaaattgaatcagatttcttgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacctgggaggcggagcttgcagtgagccgagattgcaccactgcactcccacctgggccacagagcgagactccgtctcaaaaaaaaaaaaaaacaaaaaaaaaaaaaaacaaaaaaaaattgaatcagattttagattcggcagggatcttagagatctggtggttctcaaagtgcggccccatgaccagcagcatcagcagcatgtaggaaactgttagaaatgcaatttttcaggccccaccccaacctagagaatcagaaactcaaggggtggggtcaagcagtttgaattttattatttcattatttttgagactgagcctcgctctgttgcccaggctggagtgcagtggtacaatctcagctcactgcaacttccacctcccaggttcaagcaattctcttgcttcaggctcccgagtagctggaattacagacatatgccagcaaatttataaaataattataaattttatagttttagtagagacagggtttcactgtattgcccaggctggtctggaattcctggtctcaagtactccacctgcctcagcctcccaaagtgccaggattataggcgtgagccaccccacccggccagctatttgaatttttaaaagcccctaggtgattctggtgcttgctaaagtttctgagccacccatcaagccattctcttgcattttacaggtggagagactcaggaacagagactaaaataaaatctctgtatttcagttgcattgctttgtttgtgtcaaagttctgttttcctccccttatctcaagtaccacttagtgtttgttccatcatttcttcctttccttaggcatatggctatcaatatgcatggtcttatctgacttccatttaaccaatttaactcaagctttccttttcctccaaaaagctcctcccattgcttactgcactaggtcagctcaatgtttgttaggaggctactctccaggttgtctgtggctctagaatgtttgtggtgtcatcatgtttattccaaaaataatcagtcatttcatttaagtaatgtaattcttagataaaatgacgagatatagttacaaaataaatgagttgtttctgtaaaaaccaagttaattactttggaaagatagacgtaaaagtaatttgtgtcccgtcatagccaataaagtaccattgaattaggtaagggtgacacaactgcaggtaaatggaaaaatatttataaacatctagatggattctaaagttgcttaactttagaaacaaactactgtttgctgttgatattaaaaacactaaatctgctaatcattggtcatactcaaataagagttcttagtcccaaattttaaaaactggtgaatctaatatacagttatgcatttgaggttaatgtcaactgtatacatacattttagggttctttgcttcacttgaggttttgtctaaatgatcaagtctaaactgaacatatagatcaaggttccttctgaatggtcttgattgctttagatctcttcatatatgatgattaagctttttgaaggagataccatactctataacccacagttttgcacagtgaagttgtaataaatatttactggttatatttatatatacattttattgaatgttgctaattgattagccaattacacttagtagttcatcatctcgttttattactgtgagccaaattatccaggctatgaaacatttcttttatgatagcacttcctggagtccttagagaaattccaaggggggacaaatagttctataaatttcctcttgaaggctcacaatgcattaggctgagaaaccctgctgtaaagaaaccagttaaacttacttttacccatacttatttgactacagaaattcacccccctgcatcaattaataatccatgattcaatgtgcacatatattgatgaggtatcccaaattttctaagtgattttcattcttatgttcaaacctttttttctgtttctgtagattttctcatacttcttataacccagaataggtgtgaattatgtatgccaattatgaatgcgtcagattaaatggtcaacatacggatttgtaaaacttagattggtaaaactgctatttttttctattttcttctttcttctcaatgaagtagcagaacattttaaatctagctctgctttcacagattaaaagaaaaattttagcaggggaatgtgaaacttagaatgtcaaataacaggcagtggtggaggctttgatgaactgagcctaattaaaagtaaaggtgctgagtgaaaattttaaaagactgcaagccaaatgttgctaaggacaatttggggtacaagctttccaaagagggaggtggttttaatactctgtaatcattttgaaacttcatgctataaaagacttcagatgtagaaaagcagtctaggtatcagattataacagcataggacacctagtctaggagcactcaacctggagtcgagaaagcagtaataaatgccctttacactacctctgtccatggaaattgaatatttacctgagataaggttgcccaggctattaaaatctcagatgttgaatggcagttatgtaatgagtttctttgaaaaacagaaaatgaattgccatttaacaaacactgcctggaatgttgataattgaagctgtgtgatgcgtgcttgggggttcattatacattctctccactttggggtatgtttgaaaatgaccaaactaaaaaaaattctgaaaaaacagcctcctttgttcccgcttaaggtaaagcactttctaagtgtacagaagtcccccacagggcagaaataacaaagaggatcgtgttcagacccactcaccttcttccaatagctaggactggactattggtttcttaagccatagccaaactgtgatatggtgaagctttagcagaaaaccatgtgacttgatgagattgcccatgcagaaatgcaggcaaagaattcagcaagaggtatgtagaccaccttgggaatttgtacctttgtacagtatgcaggccacaaagcttcactctaaaaatgacttacatgtagaattattatctcagattttaaagatgtgtttattcctaagcctttagaaaatataaacacaacaacaaaggcatacatacctatctcttgtaactggactacattcacagagctccttactaaattctggaagaggttttgctaagcttgtagctttactattgtaccctacaaaccaataagtttgagtttaattgaaccaagatagcaaatggatttcagactatagtacctcagagaaaatagtctgaaaccaggtcaatcattttcagacacacgaaagagggatgaaatattaaccatagattgtagaggaggatttttgtggtttgtaacatgattggttatggtttttcaaatctaagtagcaagcatgagtccagactgagaaagcctctgcccaattgattagaattggagttggttcaggttgacaaagtgagagtttaggatgtgaagaatgactgaccacctataaaccaaaatttggactgaagttgtttcttcaaagaaacagatttctagaaaaccaatcaccatcatcataatcatcatcagagtaaacaagcatttaatctatctgattttatccagttttcctctgagaagatgccattggcaaatgaccagactgttctctacctttctacagagctataacttcagtcaagtgagtgacttgcacaagatcatacagttttatccaatatctcttatttttctacatttctacaattatcatttttttgatcctgaaagctaagtatgtagtgaaagtcatggaattcagagttgtttttattaagacacacttaaaatgaagatttaaagatccaggagcttgatttatcagtttaacattttaaaattgcctactatatatgcaattgcctactgctttaggaagtatttgatttttactagggtttttgagcatgtgtaaaacatagattatatctggagaccattcgtggtctctgtttgtccatacaaaaatccaacaaccctagctcttgataaaatttggaggcttaccattgtgaccatttgaggttgcatcttatatacatttatcttctgcattcatttacagtattcactcttagcttggaggacagtataatttaaaaaacccagcatcttcaaataatctgtatttagacaacacataggtcaaatctcaatataagctctgcttcagtgacaaggaggagccttaccgcagtgaagggaaaaatcacagaaaaaggcactccaattcacaactcttctatacacatctaggggtagttagggattcaagaggaaaaagcaaatcaaccaggtgaaaatggcaacaacaacaaaaaagatcaggtggctgttctgaaaaaaattaaaaggccctttttcctcctctcttacctattttatagattgaccaaaaaaccctcagtttgggttgtacttgggggttttgctcttctcatccagtcctgtgaaggaaattcacattgcacttaactgggtgatcagaatagagcagtgagaaagaaattaataagcctttgcaggctgaccaatgtcctattggggctcaaaagtttgatgggataacttggaaggtccagcaacttaggagagtttgaagacagacagcccccacccccagctatgttttgtatccaaaaagaaatttttgctagctgaattcatcatcatttactttgtcctcagcacagagactgcttgcatatgcaagcttttatttcaaaagggattctcttctgattttggtgtcactttatacatttctgtaacaagaaattctctcggcagctgtacttatgttagaaacacaaatgtaccttattaatgccagttatcaaggcaaagggtttgaaaatacttgctaaacatttgtttatttatatacaatatttcagagttttacacagctaaatactggcatataacaaacactgtgagtgtgtgaaagaaatataaatgattccagcagatggcatggtcagaagcaaagggtttgcaagtgcaagaaatagcacaaatccaaattgagaaatctgaatggctgtaattgtaacacatctacaatggaatcaagaaggtcatttacattacgttaagaaatacagaagcagagtcttatataagcgtgttacacaaaatggagatttggcacatgggttatcattggacagtgtaccacacacagtttttatttcggttccagcagaaaaacaatattgacaaatttctttctctctttgcttcctactttatcgaatagaagaggtaacaatagcatctgctgcagctggctggagcctgagatgaggaaattgtagctgatgggcctcccaagcatatcgacactaaaaagctcatgctacagccacggcacagccaggctagcactccaacgggagcggcagatacacaaggcagccactgtgaaccagagcagggcctgccaagacagcatgtcaagtaatttttagtggcctgaagtggtttccaccatcacagctccaggcactgccgcaaggcaggacaagtttatctatctctgacatcttctccatctccctttggcatcgctctacgattttctgctgcggtagcctcactgaccaaattggtacccagtgcattcagggtgctccctggctacccatcagcctttcttcccattattcatgggcttgaagatctgggatgcttaattgggtctaatgtgtcaaaattacctactccaatcatcttggtgtcaaacataacacttcctctcaatatacaggtgctttctggttattttcctaatgcatctagaaaatgttaagggaccctttaatcaaattgatttgaacaaaattttaaggaccatactgcagtggaaaacatactagacccgcagtctgaagacttgagtccagcagaagcctatgggaaagctgtcaacctcattggcctaattttgttttctcaactcaactctgaaatttaaaaaaaaaattaaaaaaagagaaggctgcaggaggggaagtggtctgagagtctggaaatgtcccttccacggctatgattcactgtgaatgaatcatagtcctgtttctgagttcaaaaagaggcccactagccccagtaaatcttgaattacaggaagatgtaaagaaaatatttttgagttaggatgtaaggagagttaagagcacaagtttctcctacccacaagctaatattttaccagaagtaatcaggtagcagttatgaaatgcatttttgagaatggacttttttcctactttcttacctatttcacatactattcataaaccctgtattttggggtcagcttagggggcttggctcctctcatcgagcctggggagggaaattcacattgtatttagccaggctgatgagcatggagagcagagttccaccaatccagtaaataaggttcagcaatgtggcactcagaggtagaataaatgaggtcataaatgagttgttgttttcccatccaaaggtggagtatgcttccccattccttgaatctggaatggcccctgacttgttttaaaccaaggaatgcagcaaaagcaattgtctcaaaaggccttgtagcttcccctttgatgtcctcagaaccctgagcccactggaccaggatgaaaagccttggggagaaagagagaccccatttggctttcccagcccttcaagctgactgagaaaaagagctcaggagagataggcagaagatccatgtcctgccccaagtcaacccacagacttgcgagaaaaaacaaattactgtggttttaagccacagtgttttgggttggtatttgtaggtagcaatgctaactgacagacataccctccgttctgccaactcctgtggcacacaggtgtaccagaaacagaaatacggttatagtattttaaaatatgattcaatgctcaacaccaaaacaaatgaacaaaaacagagagaaaagaaatattctcaaaataatcataattctcatcatcctctccctttcagacattaaatgaaatttgagcaagagcaagtggctgtttaccattggaatggaagagccacagttaatcctgactcattttatctagttctttttttaatatactagagatatgacaaaccatacactcagcaagcaccactgtgcactggtgaaacacttaactgctgcctctcccttgatgaactgcaatgtagagaagaattttggggggaagtggaagaggtattgagggaggtgagatgggaagagacagaaaaagcaagactgctcatgtcccttggaagaaagtagacaaaaacaaaaaatgaaaaatatttaagtttttcataagcaactcatctttggtaaatttctgtgatttaaaaataagtgtgctgtcccagaaatctgaaccctcaaaaatcaaagggcaaagaatttcaggaacctgcaagcttgaggaggcagtctgacattatgactcactttctttccattcatctcatctgttatctttggcctccattaaacaatgagaaagggacagtcactaagtcatatgccacttgagggcactcctggggcttattgtttggaactgccaaaatgctggacgtcataccaagtgtgaatacgaagcaatgtgactaatatcatagcacaaaagactagcatttatcaactccaaagagcatggcccttaaaactagccactttgagaggacaaagatttaatgcaacgctgccatggtgcaaaaatatttttggaactccttcttggcagtagagttaaacgcctacggcctgttcttttgaatccagtaatggtggcacatctttgtccttgaaagtggatttatttatttatttttctagtgccaagagatacctggagccaagcgtatggtttgtatggttggtgaccaaggtaagaaacactattagatttcttttcaagtaatgagcctagttctctgtatgctttaaaaggttataattaaagtaagtctcacaaagaagttctccaaatatttaaaataagagttgcattcaaataagcattttttttttaagttagaagctttgaggtgggttatcgtttggacccaataattctgccaaaattaaaaattagttttattaccataagcagtggttttcatgtaggggcgattttatatccaaggggacatttggctatgcctaggacatgtttttattgtaacaatgtgggggaagggaggtgagggtggtgagcaaagcccaaggacgctgctaagcatcctataatgtataggacggctctcatagccaaaattctacgatctaaaatgtccaaactgctgaggttaagaaaccctgcttatagaaacaattggttctaataagcaaagcatttattttagtgcaatgatataattataacagtacttaacacatttttccgtgttaaatattccagttgccacccatcttctatgttaatgtatacatgcacatgttttctactcttctgaatcaacaattacgtagaactcaaactcacagtccagaaaatataatagtattctttgtggacattaacagagtcaatttaaataactgtgaggtaaaacaataatttttaaaagtcagtaactgtaaacatttgttgacttctttctatgtaacaggctaatgaatcactttacacggctcttatttaatctttaaaaccaatactatgaaagaaataccactattatccccacgttactgatcaggaaattgagtcttagaaagattgtttaatgtgctcgaggtcacagatgcagtaaatagtacagctaagatttgaactctgtttgttagaacaatttcaattgcagagttttcactaccatacaatgctggcccctaagagcagctctatgtgctaggagccatctcatttgtaggttagggacagttctacccccatttgtaggatacacattgagcaaaatggaaaatggcagtataatatacacatagatcagaaagggggttctccttctgattccgcttactagttaagtacgttttcttcagcaaatcacttaacttctcagggtctcaatttccttagctggcgagtgaggaaagtaataatgcacatctgccactcttatcataaacatcaaataaaataagtgatggggagatgctctgtaaacagtcacttacaacacaaaagtgagttggttgctattcttaggcacgaaatgggaacaggattggtgataggttctcagttgcccttgaaggaaccttcatcaaatagacctgatatatgattttgaagttagatagtattgtattactattggcctcacctctcttccactgcatttatatctattatgcttcttttcaaataaattctgcatttcatcaggcagccagaatgctcttcctagcacctcaacttctccattttgagttttacactttatacctactggggacactatgcaattccttttaatgcttttttttttttttttttggttccattacttttaaactattttggcagaaggaagatatttttctatcataggactgtgccatcaacagactgaagacccagcctcctgtttttaacactatgttgtttcataaactacgcatttgcttcttatacagaattattggtgtatgaaaacagaatctggcataatgggttccacatggcataattatttttccttaccttaaaatgtttccataaataaggacataatttgtacactccacccattcttatcgagatgttggcatttttaacaatcctacctttcatctacagaaggctagcatctcctattccgtaatttacacataaagataaaccccaggtttaaggaaaacatgggtctatggttcacgtttgtcagcatctcaaaactatcacatgctttggcaatacttgtggtctttgatctgaagagacatttgaatggaacattagaagaaataaaaatggaatttagaatgaatggttaaaaatgtattaaacaattttccacagcactcttagcttctttggatcacaaggtcttttgtttttatgctcttatgcaatgctttccaaaatctttcttttgactttgaaaaggccattttcatcactattgggttgggcttaggggtacatggttatgctatgaatatggcctacatagtttcctggttgtgcttccatatgcaaagtcaaaaagtattatgaagattggaacttaggagtttttacaaccccaaactggcatctgattttttactgggccattttagtggcctgttggtgcttctaggaccttattgctctctatgtggtatgcagtccctattccttccagttctgaagagtggtttgattctatgattgtgatagatttaagtgatactcaggaagcttattttattttccttgagactgtttcacttagaagatcaattcaggagttgtgatctatccccttttcaatttttttcataaataaatgtttctcttatgaatagaaagtcttccttttgtcttaaaaagagttaatgtgacataagatttagtatcatgggtcaaggttttataactgattcactgaaattacagctttttcccaatgtattcattctagtatcatgggtcaaggttttataactgattcactgaaattacagctttttcccaatgtattcattcctaacaaatgcaaatacttagagcaaatcagttgtcatgtccctctggtactagaatatagtctttatagaatatgtggtttagaataaagccacaaattattctataaaacaacataaggaacaaggctcaaaagtggaacaaaacggccttagtttctaagtggaagactaagacgatataggaaaatgtaatccatgacctcttaagaaaatctcagtttaataaatagaaagttctgccccaaaatcacattttataaataagataaaaacaatactatatgtctctattcatgcactgcacatatatatatacacacacacacacacacacacacacacacatatatatatatgtgctgtgaagagataatggcaaatatctgacaacctttacacatgtgcagtaaagagctaagtataagggactaggtggtctctgcaatacgaagagtaagaactggatataatgatgggtaaacaggccatggactttgaaatcaggatgaaatgtatatgctgtatgaccttgaacaaatcacttattacctccctgtgcggaatgctctttgcaagcaaaatatactattttctggattaaatgactgctcagtaatacttggaaaacagtaatggctccatgattggtagctattgtgattatttatgttccagtgattaaagaatggaaaagactcacatgctagcaattgcctttgatttagaaagagtgaaagaaaggccagaatatagcaatgtggtatggaatcagaaaggaaggagtggctcattctgaccaggtcaccagggaaggcttgacagagaaatcagagaaatgcccccaaagggacagcagaaaggggagctaaaaaccatcatgggacctaaagtctggagaatctgcctgatttatagggccatgcaacatggggaacataatggccttgccaccactagtagtatgagctcaggcaagcaagctgatcttacctggcctctgctgttttttcttctgtgaaatgggagactaaaattactccttgtaaattaccacgggaagcgaaaagcagtaacacatataaagcacttatgacagggcctcttcagttggcaagaaagattatttgatgttgaataagtgctcaactatcctgaactattagtattgctacaaaatggggagctatgtctaaatttaatcatggaatagatggtatgtgggaaagaacatgaaatgtagagtggtagaaaaaggaactcagaaatagttataagtaaggcaaaggcaatttaaaaagtaagctctcataaagaaataccccaatataaagggaaaaaaatatagtctctaaggtgaaaacacaaaccaaaaaaatcagtccagccttgaaactcttactatttttgtaaaaattactaaaatgccatatgtaattcaacaaacttggacaagcaattattgagtgcttactaaggtgtaagagctgggggtaaaaatgtacataagccatgactcatgccttctgagatctcaaggtacgtatgatctgcacacatatagctaaacttgcacagtgtgaacctattctatgagaatttacagaatatttaattcttcctgtgggaagataaatggggaataagcttaaaatgtttctccagagttacaactcaaatgtctacaagataaagcaatgtcataaatgtgtgtaaaacaatagggagtgggaagggtttgcaaaactggatagtgcattccagcttaaagaaattcatgctcaaattttaaaaaaattatcgtgtatatcaacaaaactatctgaagccagtttgcaacctctgcaatacaaatagaaaatgctatttaagttggattatgcatcaaggttgaacaccatcaggtagagaaggggaattgttgaaattctagaccagataaatatctttggctgagatccagagatgaagatatttggaatgtgtagctatcagaagatggcccaaggagtcaacaatgaggtgcgaagggtgagatcagcctaaattacaaaggggcatgaatgcaatgataagcagttcacacctcatcttgaaggcatcaaggacaatggcattaagttcctttaacagcatcattttaagagttgaaaggtttctcaggtctttatacaaacagatgtattattataaatgatcctctctaacacatagcatcaacatgttctctctcactgagaaaagtctcatgggattgccatagtagaaaatatgtacatttgaaaaaatccattcatttaatgatttggatgtttataaacatctgttatttaataaaatggatggctcaggttacgtagatgatatccaaattcatgttgaatttttcttctcagagttctaaatatacacacagcttttaaaaggtactcagtaatgaataattattaataatttaaaattactgcatacttctatatgccatgcactgtctcaagtgctttatatgtatctattttatgtcatcttacttaatttttataaaattctcattgctatagcgttatcccattttacaggtgaagaaacagagattaaataatttgtccaaaggcatacagccagtaagtaaacaagctgacattttacttaggcagtctatctctccagagtgtgtactctcaatgttgagattctatgctctgtatgaactgatagataactagagttggcctttccttgcttgcctgtttgaactagaccttctttcttttagaaatctggtagactctgtcctccttgaccttccaaggccttgtctgcgcttgttgcactaggctatccctaaaattcttttttgttgttgattgttagaatttcttttacttaatggctcatttttgtcttagtccaattacagcacagaatcattggaggaccataatttcctttttctgtactgcaccgccagcctgaccttttttgggctactacctgacttctttgaaacctcctccattctcacaggatatattgggcagaaggcttggatctactttgtcactacttctttaatatagaaaaaaagtttagtacataataaaagaaatcacaacacaaaatacagtattcaccttccagactattttttgtgattatgtgtaacatgatcatgattaaccgtgatcagtatccctttgtaacatggctattgtggctttttgcatagtttctttctgctcagaaatggtttctaaactagcatttctgggatgctacacggataactgtcatttaagaatgactttaatctgctgctttgtcacaaaacattatactgtcaagttttaacttggcttgtattcaactcaaggattcaagataacatggatgttgacgatgttgacatgaccctcctaaataaagaggccaaaacttcttaccagacatgtaaaattacctatgggtaattatttcacagagctcagtttatgcagttcctttccctcattgtttcgaagttgctaacaaatttcttccaccaatatacctactcttctgttgtttgtttcaataagcagcttctccagagcctcaggcacagcacttccaaatgtcagcagctattagctcagcacattcatctttgtttccttatttctcctgagtagcctgtctctctcagaggtgagtccaggtggcttaacataacatggatgcgggtgtgtgtgtgtgtgtgtgtgtgtgtgtgtgtgtgtgtgtgtgtattttctcaaaataaggcattacagctatttaatcttatctctcatatttgctatttgcttgcaaacatttttgtatctgtcacggtgcctagcatgaaacccataccttgcttataatctacagagggtgaaatgcattttaaaaattatgtatgtatgtatgtatgtatgtatgtatgtatgtatgtatgtgtatgtgtctgtctgtctatctatctatctatctatctatctatctatctatctatctatctatctacctacctacctatctcagttttctagtgcctccactttaatttacggaaatgggaagaacatttggagaaagcacagattctgtattttgaaatgcaatgtgaaaaaaatcatcatgctgtttttcagtgaaaactcccaaattatgtgtctctaatttttgttcccattattttaaacatataattacacacgtgtctgtgtgtgtgtgtgtgtgtgtgtgtgtgtgtgtgtgtgtaccgtatttttgccattaggcatataagggcaacatttcttctgctagaccaaattttctgtttctctatcctttggccaaactctatctgaaaacaattcatgtgtttcatgtgtgatttttataatcaaggtcagatctgaccaagcagaggcaccatataatcaggtacattggctctttgaggcctgcaaagaactgtgagcatacagactgatcaaactagcacctgaattaaaaccaaaaggcaggagaaccagaagtctactttcatgatgtaaaaccacttgctcaaattaaaaataatttttaatgttttacaatcatgcagaaaactgcaactggagtggccagtcctcaaaggaccctgtcttggatgtagggaaacaagaatctagataagacttgaggccgattacgccatcaccttcttagttatcagtacttgaagcaaactttgtagcctctcacttctcttgacacgacataattctcttaacccaacatactgttgttatgaacatcaaacaaaataaagcataggggagtgctttgaaattagtaaaatactctccataaatacaaggtaatgttattactagtttttatctaggaaaacatttgctggaaaagagaaactttatcctgtttggaacttgccagctcattgtttaacaatgagcattgtagcatggtttggctaggtgaatttcactgcttttattctgatcagcccgttgaccccatttctaaaaaactagctccttttctagggtctactgtattatatttatattatagtataatatggggtatgaaagagagtgatggtattaagtcacgatagaagtgatttacgatagatgctttcttgggtttttcctatactcccagacttctattttacttatctgtggaagaagcaatattttctcatatttgaatttctcaggttataaagaactatcatgaaattatatgcactatacatttatatagtaataaatagactctgaccagatagcttgagtagtctgctaataatgatacttaagaggcactcaaacaactggaagaaatcagcttaatatttaaaaatctataaacatttatatatatcgcaatctgagtggtgatgtagctgttagagttaagcaaaaaatacaaactatacatttcgagagaaatacaacttattacctttgagtacataaaacgacttcttccaaattatagaacttgtatatattctattaaatacatttttaaaaatcaaattagtgatttgtcatgagacttgatattactaatgtacagaaggcatctttaagcaataagatagtctccctaaagcttgtatgatatattattattttgttcagtaatttttttcccctataaatagtaaaaaggttgtatcagtccagcccacaagaacttgtcaaacaatacaaatttgtttttaagaatattcccccacatattattttttgttttacatatttatagccatgtgcccacttaattttgtgtttatttatttctcttcactgggaaaagacaatagcagtggaccatagctacctactatctccaggggaaatatgcatctatgtcaaatccatcctattgatgttagcataggcctcatttgaccaaaagagagctgtattatttatgaagacatttactattccagaatgtcaagaagttgcagaaacatccaatgagagtcaatttagctttctgtttcctgactgcaagtgaacaaacgcttcttacctgcagtgcacaaccatcggaccagcatcgggagggttacaggttttgactctacgtaagaaagctagaaaaggtgtagggtgttctggaacaccatgatcaggccaggcggtgaactggaattgtctcacttctctcttctcacttgaaccattctgtgaaataggaatatcagctgaaattctgttttccaagcctcaggtggtaatgatgaataacagggaagaggtaatgctaaaatgtgctattttaattcctttctaccaccctgtagcctttgggaagacacactctttggaaatagaaaccccaagctatttgtaaatgacaaatatttgcgcaggaagacaaaattcttaggtgagaagcattatatttttcaggtttaactaccaggagagctcctatcacattttacaggaagagctagttcttcttcatctactcttcattggctgaaactttcatttggagcaagagttttatatttactgataaatcgccagacaagaagaaaaatggctgagtgataatggaagatctatttcattcttcactgttgccattgagatcaagatttaagtaaagccttaagagatttcatttctcaaaagaagctttctttaaacaatagagaagggaaagggaggagaaaaagatgaaaagcaaaccttgtaaagtgcaaatgttcgaacacaatatgtggccagctccacagtatcaagcagcgttacttgaacgagtccgtgggtttctgtgcctctgctaggccaatactggtcacacttcacctacaagaaacaagtgacacattcagggcaaatgctcatcaatttctctattaactttgctttgagttgctgttgaaggaaaacagcttttctgcacttcattttatgttgatctttttctggcatgcatttttgttatcccaatatatgtaaattactgctctgatgccaatataaaccacatttttcaaactggtaggaatactaaacagtaacagattcaattttcctggagaaaaataagttgcagattgttgctgggtaaaatacagagagagggatttgaaacttcagtgagcttgaagagaaaacaaatttgtcctgggatagacgttatgaatcacatcgggaggatgacactttgtcatttaaactacatggtaagatagtgttacttcatcaagatttaaaaagcacaacttccaaatatgcttgtttaaagaaaagtagaaataattggaaaatctatcaaagtataataaacaacataagcatgtgctttttttttgaacacaagataaatgttatttgtatccaaagcaaattaaacctataatgtctgcaggaaaaagagttgtctgttccttaaaaagagtctcagagggtcacacactaacagtgcaaagtttaaataatttaaaattcatccaagatgaataatctacaatttctatgtgaagtggaacaaaagcacataaaaagttttcagcctaattagtttaacacacaacaaagaataattccaagtctgcagtaaacctcaaattcactgaatgagtctgttgggcattaaaaagtataatgaaaagtaacaaacacagcacaatatttttggagtaaggccatagatctgactatatttaccctttctatctcagacttttttttaatgggactaattcttaagagaacccaactgaaatacatttctctaggtaaagaaagctcctagcagtattttacaatagggaatacacctttctatttgaaaaagaacagaaaatcacaatctttggatttaaacaaaggcaataaagcattattattagagacactagaattttttgggtccagcaaatagaattattacataatgatttgcttttatgtttaatatgagtatttgtaacattctgtgaataatactgtaattttctctttcacagagatagcatttgctcctctgagaattcaggctctttccatgaaactattggcccttctaagaaagggagaagttttatcctgtacagaatttcccagacaagacaaaaaagaaaagcactttatagctatacagtaagctagatattaaattcacaaggtttgattcctatgccttgatttcaactttgagaccacacaaacatcatctttttgatgaaaacaaacaaaaattgtccacagtaagacaaaaattttgccttaataagatgtaaagaatattttgtgtgtttcctagttgtacaaaatagccttctgtgttttttatttctatcatttgccctgactcaaagagataacaacatagggaaatgataattcttgaaggagaatactgacgtagagtgaccaggcatgggcatctctatatgttctttcaccataagctaaaacccaggtcacagatgacatatttagcaaaagctaccatctgaatagaaccaacactacttcagcagtcatgatatagatgagaaaaaaaaaattaacaaaaattatgccaaaggctttgttttaaaccatgaaatagatgtcaggtggatgtctcccagcagaggacaagaggaactctggaggcctcatattgtaatattcaagaagatgccaacaatgggttgagttgaagattcaagagagaaactcaaattcatcatttaacagtctcagctggagagcaaccctttcggtttaaaataaactaatgaaatccctaaggacaaatatcactatgatatgcacaaaaacagcacattaatgcaacaaaatgatctatacagccagttcaatgcactgaaccaaattcaatataattatattttaaaactgggactcgattacatttagaccttctagtgaggtaagaaaaggagatgaaggaaagaatgagaaggcaaccttcatacaacttttggaaaaatgactctccatctacaaatcttctccattcctaagatgcaggaagaactaaaattatactaatccttacatttctagtaataagtttcaaactgcaactattattggcttagactctgacccctttagaaaaaaaataccaggaagcattactgtaaggagtaaacgctgtgaaaatttctagctaaaagaagaaaaaagttgcttttgaacaatgcatttttagtatttaccaaaagaaaaataaacatttcaaactcaactgcaaaaatcagaggcaattttttaaagcggatatgtctaaatattaccattttctctcaggaaatatttctcaaaaggaccttatgaaaaataaatatcctaacgtatgtggaaatgcacacacatggcctcagcagtgggattagaagcttttcctgagcttatctgaatagtgacagcaatacatttttccctttgctggtaagcacctcagtacttcctttctcgatctcattctctgagtagcctgcacaccttcatctgattttggagggctgaatttaagggcttagagttactgacaaatattattttaagtctccttttttgccatatgctaaacatatgatttctgatttcagcattagggagcaagtatgaaatgtagtgagaaagaaaaaggagaacaatagagatattttttctttcctcattagccagtataaatgaactatctccattttcctctcttaaaatgttttcctttgacaactttccttcccctactcggtcttcttaagagaaaatatcataaggtatttctagagagagttactatttgttaggcttcacacataaagctgattgtgagatgagaaatgaaggcagctccctttgagtacataagaactagaaggcaggagctactgaatacgaatacggttttttgcctttttctatttgatttagaatggatacaagcggcctctaggactgattcatggaaggtcaggcagagtctccctggatgcctggaaaattgtttctctgtttccaggaccaaagtctggccgcctcatctgtgaaatgggaacagtgtctccagcattacagagctattgtggggattgaagtgatgcccctaaaacacttaacccaaatggctggcacaaacaggcattcaacaaacactagctatcattggttatcagtttgatgacattctggatttttgtgtgtggggggttgttgttataaattacctaaatcagtctaaatgtgaaaaaaaagaacatgttattaatttcagcagatactgatttaggattttctaggtgcaaagcaaggtgttagcagttgtggggcatcaaggtgacataagacccagtccctgccctcaatccattagccttactgactaagtggggtgtttctaaacctccttgttcttcaaataggtggttctgagattccaaacaattctcttcatctatgtgggccccaatgtcttctgaaaagagtatgtgttcaactcagaggtggaaaagaagaacagcagaacttgtcactcaggctgtggtttagaaacatcacccagtaactttacttgaagcttaaactgagacagttcagatttttggctaaatttgcgggaggcatttcttttcattatcacaaagttattacccttaagtggagctttcatttttctataattacggaaagaacagggtgaccattgctaaatttatgcaatggaattaatttattttacctttttcatgacaaactatcaaaatcaagttgatggaataataaaacatatttaaatttatttttaaaactcttgtcattgcaaatatctggtaggagctgatccattaggtctgctgaacatgctttgggagaagggctctcgttctaggctatttttactcccatatggcttaccttgggagtgctcagcatattgtaggcacttaatgagcggtagccaactttataatcaattaactagattggcttatttttaaattgtctaccactttctgaaaacaaaacctcctcatctcaatttaataaagacttactgagcatggcaacatggcaaggcatcagaattccaactgtaacaaactgataccttgaaagggttctagcattgctaatccaaaacgtatttgccacgagattatttagccaaagaaggacttagaagaggcaataaatgatacgtgggataccataactattgctaaaagtgactctaaattcgtacctagtaagtttgggcagagtggttgttcaagcattagtatcctgtaaggaatggacaaacaggctaacattagataacacaagtcacagttatttttgggagtaaggaaatgttggtacccttttgtcaatacccatttaatgagggagactataataaaggaaagttttagataaatttcattaattttagtgggcagaaaaaataaatgctgaactatttatttctacaggttatagtaactattctggaaatttttaagaccagattgaatacttgattttccacgataaggacagagagcatctcagtgattctcttttaacaacagtgtagttctctgcactcaatcaatatttggctatatctattcccaactggcagtcagtctggtttgtgtattcccccattttattatatctttactaatcactatttagtggaggacaaagaggcactacaatatttgaaatgagagtgatattaaagcatttgaccaccagtgcagcttttcatatatacagccataaagttgaaaaatattattctcaaaataaaccaaattacatgtcataaaattgcctaccagttcattgaaccattcgcacactttctaaactgcttattaactttaaaaaagttattcccttttgtttgatgtgtctgccagaagttgacatagggagctgccgtaaacttttccaatgacttcccccattaaactgaaagtcattaagtctcaagtttctggcactttgtcctaaccagagcagaactgtgtgaggtgcctctttctcgtggccaagtagcactttgatatcagctcttcccacatgaggtgggtcctcagagtatccacctcagacctaatcactcctgaggatcacctgggtgccccacatagccctacagccacctctgcttctgccttggtctgcccagcagttgcctttgactccagtgtcacctcttccaaacagtatcattagatgactcaatgtttcaataaaaatataatttataggtaccagccagcatcaatgcagttcaatattttaacaaccagtacaactatgttgggtatttaccagttgaacatcagcctttccagacattctgctgataaagaacagagaaaaaccaaacattggaccctaaacactagtaaacagagattaacacatacttctgaaaactttagaaatgagacctaatccagcacaggagaaccacagacatgaatgcagagaatgagagaggctttgtacaaagtcatcaggagcaaagttgcatctcctcctcccattccagctctttactcaggtcatcaggactctaactggctttaagaggaatgctttgagccagaatctgtcagctgcctttctaagtagagcaggtggggtggggaaagaaggtagataatccagaaagctaacaaacagcaagaaattggtgggattctttctcttttatctgacgctgtgtctgctgacaagagaaaaccaaaagtgtagaactttctagataaggaccccaacatcctttagattgccaacatgagcatcattctttttgttgccagcgtcctatttacattaagtatccaccactttcaaaaacaatcccatacatcatgcagactccaaaggcaatgtttgtgctgctggtcctaaagttgcttaaggaaaaaagcagtttctgttgccctagataggcagcactttaggctgcagtttgagaaattaaatgttcacggcctttggcgcttccagttccatttggaaaaggacacaaacctggcatttggaaagcatttgctctccattaaacttaccgaaccttgacaaaccagaagggccaagaattagtctgccactggccaaggctggactttccaaaactgataacagcaatgaaaacaatagcactgccatttataatcttcaatgggattctgtcaaattttaacccaaaaggatctcacaatctgaaaagaatctcaagctttgttttataggaaaagaagaaaatgtttgagcacaatctctttttctactgcttcatgctcagaattgcccttttagccatagaacaaaatgtgaatgtctccacctcaccttcactttgtgctagggtaagtttactaaggtgacattcaaggactggggaagacataggaggaggagtgagtggtcattaggtcagaagtgttccaccagccaaatgtcaagttccctaaactgttaacaaagtgaagttaacaccagcccagtctctttggccctgacagcatctaacctgcattcattagcacaaaccacaaaatttagtagggcaggaattttcccattctttggcctaagatagaactcaagtcacgatgcacaaaacatttgatctgctttactaatatatggcatcatctggtttgtatgattccctatttggaaacagaaaatgggacttaagatagcttggaaaccaagaattaggattcttcatttctagccctatattttcactactaattggcacagcccacattggattacaataaaaatcatgactgatttgttaagtgtcaaaatttcactccccatctccaacatttataacgctaagtacatttacaaacagctctttaagtgaatcaacccccactataaagcttgcaagacaagataaacattgagtctctactatgggcaaggaatgaaggcaagctggtgaggtgaagtaaaagtcagatatattctaaccctgactaagcctttcaactgctaatactaatcagggttactcaagaattttctaagcatgaggttgatgcattctctctgtgttctgtatttcaagatgggagacagagtaggagagaaacagtcaagagaagatagatgaagggaaaaaggtgaacactcacacactaaataataatttaatatacacttacttaaaaaagcagatgaatcctacctcggagatgccaattctgcaagcaaggctgccaatcatgtgccccagtcatcaaaaataatatccttggagtggaaatcccagctgtatacattttactttccctacaaaatgcttcattttttccaaacagtttcctccttccatgtggttgcccagaccaattcgtgtgcttattggcatgttatgaaacatggaaacaattagaaaccacattctagggaactagaatgacttgctacagaatcaatgaactacgcaaaacttgagaggatttggcaataaagatggaaactagggaaaaaaaaccactaacagtatttcatattacacagtacattctacaacagctttaaactgatctgtgtgtttcagcagaactcatgctttcccttcaaaatctccagcttctatcattgtttttttgtttttgttttgagatggagtttcactcttgttgcccaggctggagtacaatggtgcaatcttggcccaccacaacctctgtctcccgggtcaagcgattctcctgcctccgcctcctgagtagctgggattacaggcgtgtgccattatacctggccaattttgtatttttagtagagatggggtttttccttgttggtcacgctggtctcgaactcctgacctcaggtgatctgcccgccttggcctctcaaaacgctgagattacaggcgtgagccaccgcacctggcccgttgtctttgtatttctttatataccctaatgaaactcatatgaaatattcaacttatacttttccttcagggttgatagctgaatgtatacaccaggcaaagagtcttctcagttaagattggaattctttaaaggccacatttgaagggaagtaatagcatttgaaaatcaaagaactcatgttttcaaataatcaacttaagtcctaagtcatagttcacacttataagggtttctttagccatgcaaacactaagaatgatcagttctcaaaacagatgctagtgaaacttctaatacctgctaaggaatccagaagccttttgtctcagtgagctgttctaactcaccaaaggtattaatacaagcgctgttgataaacctcagacctgagcgacagcttaagagtgagccagccaggcacgggctggctcaagcctgcagtccaaacactttggggggccaaggtggaaggactgcttcaggccaggagtttgagaccagcctgggcaaaaaagtgagactctgtctctacaaaatctaaaaattagctgggggtgggtgctgtgcacctgtagtccctgctgttcaggcaggattgcttgagcccagaaatgttagattacagtgaactatgaccacaccactgcactgcagcctggacaacagagtaagactctgtctctaaaagaaaaacaaaaacgagtgaaccaggctgtggcaaaacagaacgcttgaaaagagagatgggctctaaggcaggacaatttcgtagcaccataaaataaccaaaaaaggggagaggggatgtaaaactgaacaataaggaaacgtatcttcagtggcacttatcactacatgtaacccatgtctatatcacttatgattttcatgttgtattatagtcaatgtagcagccggaatgttctattttggtctgttccccggctgatctctattctggagatcctgtcctgggggagagcaagtaggaaagaatcccatggtctgagctcctctctcctcttgaataaaatgcatgggtgtgccacactgggaaacgtgggcataattaaccatgttcagggacatggagaggttggtcaggattcatcgtcaaccatagagaaataaactcttttcatttgggaacacagagtgaattatttggaggctatcttttggggaaactgaagttgtcactgtaaagcccccaacttctttaccaaacaataccatttgagactcactgagccaccttgccacatcctttatctcagtcaatacccacaataacccttccgcataatccaaaaaaggaaaaatgagaatttgaggagtcaagtaaacttgctcattgtcacacagctagtagaggctagagttggtatttgaactcagacatctgactgcaaagtgccctacttggaactgtcccatagctgtcctctctcatggtggtatccccatgcagtcctgcgtaatatcaagctatcttctcttctctttccttttctcccctcttccctgctgcaaatctatggtcagtggcagtctagcatacttctaattcacagcagcatttacaagacgcacacatattttcttcatgtaccataggaatgaatattattttaagaacctgagccttaatctaaataatgacatttcaagcttcagctcttggagaggtaatttgtttacgttacctggactacctccctttatgaggaagactggtgccacttcccttcatagggccaggctagttccaatgtctgctttgaagttggctgctgggaattgaaaattcactgagtcccaaggtcagcccacagaacccaccacgttcctgaagtctggagctatagatttcactaacaactcacccctagttataacattgtttttatagtgaaagccaattccagctcttgtttgggaatccaggaatgccttctcctttcttcccgctactttaggtaaaagagcaactggatagggaaagggtgagatgggaatgatgggagggaggaagacggaagagcagatgaaataatatgaggctccagtgctttgttaaatctctccaggacatgtggtcatttagtcccaagtgttctggactggagaacaaaggacttttgggccttggggtccagggctcatgtgtattgtcagattggtggtggctgagactccccaaatgcctattggcttatgcaggtcatcacaaatctgggtacaggctgaaccaccacagaataaaaatcacaagacagcattttaattggcttccttaggccatttaacaaaggagaaagctaacttgcaagagcaaagagtaattaatgaagggagcaaacagaggttcatttagtaacttccaaataagttcctctggctgaggggagttgggggagaaggtagcctgcaacagaaagataaactgtaggtatttaagtcacaatgccttccgccaagaactgctcattaccatcagatgttgcagtggcagtggggccagttagaactaactttattattagaagcaattagggagaaaaggggcagaatttcatttggttatttcaaaacaagtttctgtgcacagtttaatgaaggcctgcagtgtcaagataaaatgtgtgttttactgaaaacagcttttgcaaatgactgcttgttaccagcagttatctccaggcagaacagactgggtaggttggatttacatgcatgccgtaatataatagttcagctgtctcagtttcacagaagtgtcaacaggcagtatggcttgatggtgaagcacgtgtgttctggagccagactgtctgtcttcaattcctatccctgaccttggtagctgaatgaccttgggcaaagcttctgtaatgttctgggccccagtatactcatatgtaaactggaggtcacagtagtgtttcttgtaaagggctgttatgaaatatcaatgcacctaatatgttagacattattatagttatgaactattatatccaagatcacttgggaggggagttgtttttaaagaaactgcttgatatataggagttaccttaagtacaaatcagtaacaaatccatttacatcttttgaattgggtttgcatgtaaagtatggcagatatttgtcttcagtgtcatttttatcttaattcccattttagacaatatttcaacatctctatacaattcagatgttttgaaaagatctaattgctttttagttttgctaaaccaaccatttatcactgcttttgatttcccacctttgaggttacagttgtggctttttaatatgtttctgtctgagcttttcccttataaatctcttgggcagcttttaaattgtccctcatatacacgcccaggcttagagaaacttccatgtgttgagcttagaagaacatttacagaacctcaactttcacacagtaaatggggaatcaggctttcttccttctaaatatcctttttgagactactataaccacagtaaaagaggcctctcacttgtggtttcaaattctgtcttgaatgtccctattcttcaatgaaagtatctgctgtcttcaatgaagtttcagagatcccatcattaatttctcaaggttaaaggttgattttcttcagatgctacaaaatgtacacatgtactcaggaatatggtatactgcttacccattattttttagtccttcaaaccaacagcatttaactaatgtgccatgcaccataatattggacccatacgatgaataaaactcttttcttggaccttaccaagctatgactccattattaaaatctactcattttggagaagtttaaactagcaaaacgccctctatgcatttatgttttctcagccgtgtattcagccacatcatttttccagctgccctgacttaatttatactaatgtgaataatttaagcaaaagcctctttcacagaacttaagtcttatgctgcagattttaagaaagaaaaagttgaaaatagtggaagtacatattggtgggattctccccaaagcccgtaggttcttgttcaatggtgtttttgaaagaggttcaagcaaatatttattttctctaatcaagttgtctattcctgtgaatattccttttttttttttttttttttactttttagcaaccacacacatcataacatgggagaatttcttttgtgaaaacacccagaggagttttaaagaatggtttaattagagttgttgatgcccattcataattagtatctgttagaaagataagccttagggaaaggttagattctgaacagaataaaatatgcaacatagggactctgagggaaaatttttaaaaggaaagaggtggatacttattcttacccttgatctttcttctagttttgtcatcatgacaactgtggcactccgttgttcccatatcattctccaaaagtccccaaatgtttcggggagagatccctgtgttgcaatataggcattttgcttcctatacccatctatgtagttggcattcacatagtcacttcctgggatccctggaaaacaaggagtgttattcaaccaggtgagcacatcacaagaggaaacagcctgggacatgacctaatggcagtgctatcttactgttccacctcacactagagaagtcacaatatattgaaggtcgggtttcaagcaagattaaaaacaggtcctattagaaccgtcatgttaaaaaaaagtatgcaaaaaagtgtcaggtctttataatacgacaaagaaaaaatacaatagatggtccatagaatgccttttccttcactggttgttggttttctctgttgcactggcaaaaaaaatagtttccaaagaacaataaacaatctggtaacattcctcacccatgtgcttcccaggcaaaaactagataaaagaatgcctgagtctgaaaatacaaaatagagtggaacacaccataataatgaaaaattctttgtagatttagttaacaggaaactcatatataaactcatttaatatttacaacaactctgcagtaagtcctgttatgagtcctgtcaggagaaaactgaggtgcaaagaagttaaagaaacttgagcaagttgctcaagttggtggaatcaggtttaatcctaggctactcgtatgtgtcttgacctctgtaaagtattgcttctcatttaaaactcgtgatttgttgtaagcagcacatgaacctcctggattaggacagctgccccctaattggatgtccatcttctacttttgtcctctccagtttgttctccatctaacatgagagcagttttaagaaatttatttcagacactgtaacttcttcaaacccaacaatggcttccccttatacttcaaataaaatccaaactctgaacatcgcttacaaagctctgcaacttcccaaactcatctcattccactcacctccttgcctttaaaactctagacactggtctgcttcaattattagaaaacatttatttccctccttagctcaatccacatcctagaatatactctgtctccttcccatcataaaacacccagccgccatcccagaaggcctgccctggagtaccctgagacatcagaactcccttgacagccctttatactactgattaaggttgtaattatatatttacttgtctgttaagttgctttattgcctattttgaccatgtctcttttattcacctttgctaccctaatgacaaaagagtaaataattttccccagttccaacatgtaatcagtagcagagatgtaatttaatgtagatattgtgatttaaagcctagttttccatcagcacatgcctttaagagagacagaggcaaatttgagcttcttccaagaagaggagccacagtgattaagggaatgaaagctactccataagagaaagaatgcatattatagcctagcaaaggaaatggtaggaattgggataagagctgcctgtgagaagaagagaggtttagatttactctgttgagttccaagttttaaattctgaaagatttaactacagaaacatgaatttcatctcaaatacaataaagcattttcaaatggtcagaatcaaaaagggagttaagtttccttggaaggtcatgagttggctatctgtaggggagaacaagcactttataggaatgtcagcatgatatgggaaggtacactagaacttgtgcatgatcccttctaccctgggaaatatgaatcttggaattacggggtaaccattttttttttctttataatgaaacatatgttcccaagctcaaattgttatatttcactgattgccacttgcaatgactttgactgcttttctgattccggttgtaaagttgatcctctcaagaaaggtaatgaaaatcagatggaaactactgcactctgagatgaacacacggatatggaataccaccagcattagttgaaaagccttttgagcaaaacttgaaatgcatggttggctgtaacattattcatctattacagctactcaagaagcagttggggttttggcagctctttgttgataaagatcctattcctccccaacaccagattactgtagattcaaatgacggtttaaataaaattctcaggttacaaacactgggacgtgcacacatcttacatatccataggatttggttctgagtcaagaatgaatccatctaacaggaaaaacctactttcaaaactttaatttagcagttagcaacattaaagaattgataaaaaggattctggctaagggcctcactcagctgccaatatacagaaaacttttttctaagaaaactcagaatggagaaatctgggctaaatgactcagaagattcatcacctgggccctgtgccacctccccccttatcaaggaaagcaaatgtgtctgaacaatgcatctgaggatggaggagatgcacaggagaatcattcctaaagacagggaatcagacccatccaaccctctttgggtaaaaatgttaatcagttattatgtaatgaattggggttttttgcatactgcccaagtttgaataataaattctttttgtttaacaaggagggggtaggctgctactgaataatgattgcacttcccaggataagaatacaaaaatgttgcctgaagactactaggcaccaggaatcaatactatcactaaatgctttaagaatttaggaattgggcaaagtgtagtaattcatgcctataatcccaacattttgagaggctgaggcaggaggatcacttgagcccaggagtctgagccagtctgagcaacatggtgagaccctgtctctacaaaaaaataaaaataaaaaattaggctggcatggtggctcatgcctgtaattccgacactttggggaggctgaggcaggaagatttattgagaatagcacatgacaagtctgggcaacatggcaaagagaccctgtctctacaaaacactaaaaacttggctggatatggtcatgcacgcctgtagtcccagctacctgggagcctgaggtaggaggatcatttgagtccaggaagtcaaggctgcagtgagccataattgcaccaccacacttcattcctgggcgacagagcaagactctgtctcaataaaagataaataattaatattctgaaaaatacgtaattgaaaacaaaatggaatacctggtagagcaaattattaagccaatgctttatgtcctgaaaataatgctaagattcctcttatagtttgatacctatttgtaagaaggtagtacatggaatgaaagcctccttctggcaaatctctttacgcgctctggtgaaaagacatttcaggtaagttctctctcacagatcctctgcaaatgtggagataagagagatggctatgttctccagaagctctaagatctaatgagtcctgtattcataaaacccaatataacacactgtgcagaaagatgaaggagaaaaaattttagaaaggatggtggtgtgtcctaaaaatattaaccccagattggaagctaaagttaatcagcagtccatttcaagtagatgagactctggtttttaatgtgacatatttagaaagacttttcaaccaacactgtgaaaataaacaatatgctgctttccaaatgttttggtgccatgaaatgcttcttcagtagttcttgattaggatgtttctgctgggaggctggatctaacattcttccactttttggggggtgactttctctaagtagtgcatatttatttaattttcaattccctgccttttccaaaaaatgatttgcttctgctaatgcaacattaatcagagtgcacttctaatccaagagaagtgtgtgagaattaacttaattcctttggggttatgaaggatggaaatgtaacttgaaatgtagtactgaaagagtatagaattactataaattaggtgattgcttttcattcttggagtcaaggagaccttcctccaatactagaataacagtgcttgatttgttttttgggtttcctgtttgtttgttttttggttggcgaaggagctattaaaacaggaggaacatgacaaagatgtttgccttctgctcctcataagcaaaattttagaacacattggccctgctgcaggaactctcttggagtcagttggtcttagtgtctttgttcaagaacagcttacctctaagactggttctttcctaggagtccatggctctactgcatttataaaactgagtgggttttcatgatttctcatgcattgtttcatgtgcattctctaattaataacagtgatgtcaatagttgtaaccccataaataattgtttagccttctaatcttacacatgagaaacctaaggctagaccctctaacttcatattataccaatatgctccattcctgggttaaagtgtatttcctcagttaatgaactgttctttcttgtggcatttaaaaatattacttacatgctttatactgggtctttgtgttctgggctaactaaacctggctgttaatgcaagcctgtaaagccgacagagattgtgatgaggtgaatgattggtagagctgtgcttctgttgtttttcatgcacaacaagccatagcaaacagctatttgaacagaattaggcacgttttaggctctcattttatttgctgttgattgctagttacagttttcagtggaaaaatgagcctggatacagactttgaataatggggtcatgtggattttttaaaaccaccaagaagaaaaaaaaaagcaaacaaacacccaacttgctatggatttgatttttggggccagaagataattcgatttgaaaagatgtctcttgttgaaggggtgtttacaatgatgaggggtttataataaagccttaagtcctgatattaagtgaaaaagcaggatgcaaaataatacatgaattattttgtgaaatcaagtaatcctaaggggaaggatcataattttgcatcacattacactgtaggtaaagtcacgtgtgcattttaaagtcttgggacaatagcaagcacttgctaagaatttagagaaactgaccaggaaacctggactcctgtctagggctgctggtagtttactctgtgatctttggccagttactcaacttgcccagaactgtaattgtttatttgctaaacaagatgtgttggacaaactgatgccctccagttcttttgagttctaaaataaggtgtctgtctgtgctattcttaaccttcttggactcagacatctctgtgaagttattttaagataaatagaggctttgtgtctctcagattaggtaggaacgcactctgatgctctttcaagctgattcctattgcttctacctttgatgtgctgagatgagatttttcactgaggctgctacttcacatcttgattggaacctgatggggcaaaaaataaacaaaaagcaagaggaagtagtggtactaggtggtctgtccatggaaagaagctctccttggactttagcgggtgataataactaagaggcagtcttggagggaaggcagaatcccaccgtggctccagtggatgcggctgcactacagagatggagatggatgttcagctgagcgtcttaccctgctccaactcacaatttggcttcaaatcccaggtacttttattttctttaagttctataaatccctaatgaagtaaggactgtgtcaaaaagaaattgctttttggcaaacaagtttgttctttgttgtaagacagaagtactcaagacccgacagagcacaaaagctacctttcatttgttaatgtcccctcctctactccaacgcacaaacgaaaaagcataacactatattgctgttaatataggttaagacctagattgcaattttacaacaatgtggcaaaaatgtttactttgcagtctccagaaaaactagaaaacaggaaataggaaagcaaaatctaataaacatttacaagcaaattgattaaattctaaaggacacaggcctttcccccgacccttcacctgttcaatgacagccacacgtggctgcatcagacctggtgacatgaaggattctttctgcaacataccaaataaagcaaacatttattgcaaagacacagtctattgtttgccagggtatcccctggtatagctgcagtctttccaagtttctacaaaacacatagaatttttttttttaaaagcatgcctgttctgtgggcatcgtagctcaaccccacagtgagctaatggagaaacagatgatattcagagtatttgaacccaacctgcaactcctcattaatgtatgtcttcctctacttgattttccatacccccacactgctgaggaggctgagttttgagaatggacacaggaaagtagacggctgattgaactatctttgaatacattgcaagatcagcaacatgagttggggaattaccagcacctgtgatagaggggcgtgctttttggttagacagcaacttgccttaaaatacagtagaccttaggccactgaagcttaactttcagccacatcatggagttgtggtccaattagctttatactaataaggaggcaattattatagaggttcatcaagcaatgaagtagtcaacaatcaagcatgagacatgactacagaagctctatgtgtaggaaacactcagatgctcagtctcctcatcactaatatgaatatcataatcaaaaagtcctggaaccaacacctctgtgagaattaaatgaatcaatacatctgaaatttccaaaatgtcatatggattttagttactattatgattgacgtaaaaatggaaaaagtctgcttattcttaatgccctcctgataaaaagtaattccaaatctggaaggcccctttctagcttctactttaagaaaaactatcagacaggataaaaataattcttttacaatttcccagcaatctgctacctgtatctatattctaaaaacagaaccatagatgatgtaggtttatctacggcctcagagtaatgaagtgtagattcattagagtaagctgcatagatgtacaattaaaaaaaacaaaaaagctccaatgaactgaagacaatagagataaaaataaactcactcccagagctttctgattttactcttcgattagctttctgagaacaagagtaaagcaaaaaacaacacagccagccagcccttaaaaatgctttttctcttttccgggtaagaaacatcagcaggtatagtctaaggtaggagctagggaataacagatataacagcacttgcttggctacatgtaagagaaagatgccatttacacagctctaattagacagctcttagaaagactgcaagcaacctgtgaaactgctccaggtttcccaggctaagtgctatctacctttctatttaaaagaaattaagctataaaaatttgtctattcactgctactcaaaaaaaggaagtgcttttatgtatttttttaaaaagtaccacgaaataaaatgattaaacttcatcacagttgcaaacgattaacttgaaaatagaaaaactgaaaatgctgcagaaaccatgttatcagcctaaatcaatgatttatgctctgaagagtgtgagaaaaatgaactcaacaaataattggacaggatttattgtttttaaatgagttttttaagggatgggatatacattctaacaaatttcctttagtaccttaaatagaatttcaagagcaaggtaaaacaaacatgaggtgccaacaaactattcactagtgactgggaaagagagggagagaaatccggagggagaaaaagggatcatatttattgaggtaatatgggaaggagcacacagcaactatcaaaggacttctttattgggtgaaataattgtaattgttttgatgttagaacttcacatggaacatttatattcactataactaacattccattagaaaatgttggatagactgtattaacatattttcctaggtttttttggttttgttttacttattgaaaatacatccagttaccagatatgccccttgcccaaaaaaagaaaagaaaaagatattttacagcatgggtacaatgtgaaattggagaatacgttagcatgtgctcacagctgtttcaaatgaattgctatagacttacccacagaacactctgcagaagagaggctaagacacaactgaaacctagagcactagtgtggtggcaaatggtggataacattacagaaggaatagcagtagtttcttgtctttatttatttatttttaactggatttatcttagaggtggtgattccatgtgagcagctttctcatcttaaaggtgctaaattgcccatctcacaaataatcaagttattgtaacatcatctatattatttatgcttggatttttttgaattgctcctgttttgcaaatcaaacagcagatgatatatatttgaatttccatttaaaagaatagattcttgcccctgttgaaatctgtaatgctcttatgggtctggtttccatttatcaagcaccagtgttttcttttgcattacagagtacttcaaatatatgcagctttctcatttggatattagtttttccatagatcacatatcaaagaaattttgtctgcacttaaaagggcctatctgtagtagtaataaaatgcataacactaaagataatcttaacaattcccaatatttattatgtattttcttggtgccaggcactcttctaggtgctttacatatgttagtttatttaatcctcctagtaattgtaggaagtaggtactattaataatcccattatacagatgaggaaagcaaggctcagcaacttgtccgagcaagctctgcagaagcaagcagagcttcggatgcgttatcaggaaagaggttcctgagcagcatataggccctcctaagaaggtacttacttttacttattaaagagatgaagtgaataaatatatttatgttttggaactttaaatatatgaccctttctgtaagaaaaaaataacacactgctctgatcagaatgtgttcccgtaaattcatatgttaaacctaatcaccactgtgatagtactgagaggtgaggtcttaggaaatgcttaagtcatcagggcagagccctcatgggtgggattaggatccttataaaaaagcttgaaagattaagtttgccctttttctatcgttttggccatgtaaggacacagcattctttccctcaggggatgcagcaaaacagagcaccatcttggaagtggacagactgggccctcaccagaaagcaaggctgctggcaccttgatcttagacttcccagactctagaactacgaggaataaatttgtatggtttataaattacccagtctgtggtattttgttatagcagcacaaatggactaagacatggatccctattttactaagctttttaaaaaaaatcagattaataagcactagtgttaaagaatgcatattacatactaggtttattcttcatcacttctaaccctctcatggataaaaccatttaaatctgttttggtgagagtcacatagtagccaataatcctatttagaataagcccactaagctttttttttttttttttccttgaagaagctaatcatctcatactgtctaagatttaatatttatttgcctacttatcttttgatctcaggatttagaatcaatgttcagaattctggagatggtagagatggtcttacacatccttgttttataagaaaacaacgaaagactctaagtcataggttcttcctaaactggagaatgggcttgcaaagagattgtatatgcatgaactttctgaaattagtgtacaaataaagtatgtaagtgctctatgttttcaagtggggtttaaatgttcgtgaaattatcaaaaggatccagcttccccaaagagtgaatgttaactgcattaagtgaaatgctcaaggtcacattgttgtttaaactgaaatttagttttcagttttctgtctctttattcagtatatttcccaatataccttaaaacgtgagattaaacaaacaaaaaaacacacctgaaaatcatttctgtgtcatttattctttggaaaaattcattttgacttggagtctaagaacacaactgaagatctctagttctaagatttctatcctaagtgtttcaaaatgtgtatttgaaaattcttacacaatcttcccagccaaaaaggcatcagttttgaattaggtttgatgtacacaggcagggctattatgatttcaaaagccgctctgggcctgcgtagactaatgggaagaacagctgccttgagactgacatatattagtattttgaatttgtcacttattagctattgatcatacttaagtttgctgactttttaaatgcttccatttcctcatctgtaaattcagatcatgacaactagcttttggggttgggcctccataacatggtgctcggcatgtaatagataaccagataatcatatctattataatgtcttgtctttgttgttgaattgaaaagcagaattttaattttgctttatatttagacttggctaacacttttctaaaaatccatgtcaatagggcttttaaaacaaaatgttaattataatcctactaatggaaacagtactggcagcagtgaagattaattatactttagaacaacaacctcttttttatccacaactgcaataattaatttttgctaattagaaggcattataataaataacctgccactaattgataccccttggtcaacaagaaattaaagatacatacaacaatatttaaggtaagcagatcacctgtattatcattaggtttacatgtacttgacatttgttctgcaatcttatgactctggtccacctgaatgatgcatttgatgattcccatattgtgtccttgcctcaggttagtcatgccataaaataggaaatgagataggaaataggaaatgaagttctaaaacctaatatttatgttatccataaggctaatgccaaaagataaaatagatttttaggcaaaaagataagactgagcttttccacccatgctaagtgacttcagacactgtcacatcctgcaccggtaggaaagtgttatgagtgatgtgggaaagtggaagacccagaccaggaatcagaagagctggattctagcaagttatattatttatattctgtgtgactgtgtgactctgggccaatcctgtctgagcttcagttttctcatctataaatgtgaatacctatatatctagtaaaatactcacactgccgcttcactagactgttgtgtacagccaataaaacaacggataaggaaactacatagagataactcttagaagtcagaaatgaaagagattaccactaagaaaactgatattcagagaagtcaaggtcacctagctagttagtgacccaacctcagatttccttgttcttcatcttttggtttgtccattttcttttcctcataaaaacatactttctgaacaactttggattctacaagtttaggcataatattatatattctgtttatgcacatccaagtattagcttccaatatccaagtattagcttccatttggtctttatttgaaaatatttaccttttctttttttttttttccagatggggtctggttctgttgcccaagctggagtgcagtgggacaatctcagctcactgcaaactccacctcccaggctcaagcaaccctcccacctcagcctcctgagtagctgggactacaggcacgtaccatcatactagcgagttttttgtagaaaatatttatcttaactcattacaataaatcctattgccctcttcttcaggaattactattttctcttaagaactgcttaaacatagaggggatgccaatggtaattggatttgtcaaaaattcaattctgtttccatactgcttaccctataattaaacaattgaaaccattttgtaattaggactcttttgaatttattctgcatttttcctagcctaaataaaatgactgtgatttggaaagatgtcaccaagtgtcactattttcaaaaagttcaataagcacattactgcccacacacaattcctgattcttttaatttttccctgttattctctcagtggaagtaggatatacacttgctctactaaacaaatataaagacaacatcaatcactgcggccacttccagtttttgttgttctaatgtctgtcagatcactttgcaaaataatgtaaggagtaactagcaccactgagagaatagaacaaaaacacccaaattaaaactctcaaccaaagtcacttaagttagtaacattggttggaacacaaaacaagcacattaagttttataaattgtgcatgaagtcacttaatatttcagtatactaaaagctggccctgtattatcaaagctgtctttagaggagaagcctcagttagtggttctgtggttccagttgccagtattttctcttctgtgtttaagatacaggatgattgactgccctcaagaatacctgctggttagcgcttagtttaagataaaatgctgttcacggttgtaatttagatgaaagctctctatagctcatgaacttcaattaaatgcttctaaccttttgcataacacttaacatgttaggtcagctctagatttagggtgtatttgtgaacacagcactataaaaagacaggttttcgtgtgattcaagtgcttttgcttttataatataaaaccagcataggaacgaaatgtgcatagttttcaaccatcagaataaagatacaaggaggtatagtttttatccctcaacatactttaaagatgtggaaaataacaggttaagaaaaataatgacaaagtgagcaaaagtacagcgaagtggtagttattgaatgacctaattcttagtggaaacaatgctacaatagagcagaggcagactgacaagttccccaggcgagaccatgccaaatagattctcaacttacattcatttattttatttcaataatttaccttgcttttgctaatggaaaaaagatttctctctgctatttgtgactcagtttagtttttcatttattatggagatgatttaagagacttgagaccccccacaaaaaaacctgtattttttcacactttaaaatggaaaacatagagataaatgtaaggtaatcatccacatatgttaattacagtttttaaacagaatttgaaaagaagcgattacccatttgacattattatgcctgatctagtattggtaaaattttaataaatttaaataattgttttcagtgtggaaaaaggctaactcttgaacacttagtatctgtgggtgcctagaaaagggattatagtattttccaccatccaaagtaaatttattatgagaattttacaaaatatatctatgcaaaacaatgccatgttgaggtaaggagggccacaggtataggattgttcaaatgctgaaagatagtttttcttcccaaaaaaactggaaacaaatgtattaatggcctatggtgcctactgagaaagcttttaaacagtttcactttcaaataaattttggacgttgaggaagcaggtaggagatgtggtcagagttataaaataaagcggtggtcagcagagattttggaagcagaaaacagggacaggtactcgaacaactacagatgaacatctttcaactataaagtccttaaaataactgggtctgaagctactataatttatttgttttctaaaatatcttcaagaatgtaaacagtgaaccttcaagtatgaagaggccataaaactcttctgggcactaatgagggtgaacatggcatgtgccaagggtgacccaggttgactgttagaggcacagatttaagtggcctcctaaactattttctaaggactttccaatccaatgtgctcctgtagccagagtaactaatgaaatactgtgtgttgaagatgaacttctagttgttttaatatgccacacaaaagggatttatcattggaaaaatgatccgtcatgaatccttaatgaagctggatagagttgaggagcaaccctcatcttttaggaacaatcatgccctctggaacacactccttactgcaattctaagaggcagattaccaagcagtccacaaattagataaattagacatttccaacatacttaatttatattaaccaccacattatcaactttgaaattttagacagtccccagtggatatccagatttatttacaagcaaacaatcccctctccccttttaaaataaccatttagtttatgggcctcttctgacaatcacctgttcattcataacaaccaaaacccatcactaaaatgggcaacctcaattcgcttcccatataaaacatcaactacattatcaaatctttagggtaaaggcaagaaggtaatgagagatgcacttctgtcatatggtgtcagggatattgtggcctatgtataatttatttgtgtgagaaagaaaaagtaggaaaaagctatgtttgaatcttaattactttctttttttctttgagatggagtctcactctgttgcccaggctggggctggagtacagtgacacgatctcggctcactgcaactcccgcctcctgggttcaagtgattctcctgcctcagcgtcctgagtagctgggattacaggcgcccaccaccatgcccggctagtttttgtattctcagtagagatgggttttcagcatgttggccaggctggtctcgaactcctgacctcaggcgatccacccgcctcagcctcccaaagtgctgggattacaggcgtgagccaccatgcacagccatcttaattactttcagagatggttaataacctcactaaaacaatattctcatgcacatactcaaatccatgaaaataaaggtatcagtgatgtctgcatttccttaccttctatagctgataggagaacccgggaatgatcatatgcgattacattcgcgtatctattctttggtttgtttacttccaagtttgaatgttcccaagtgaactgctggccagggtcaattgactttaaaaggaaaacaacacatatacacaaaatcaatactgaaaaccaccagattataggcatttatcacatgtaataaacatgatttaaaaggaaaattctgaagccatacttcatcaagatgatcctaactgtgaagctgaacactaatgtaaccagcataacaaaaaatggttaatcactgcagaaacagtgatagtcaccaacattgattcaaatgaaaaaagaaatcaatacagatgttctgttaatattggaaaggcaggttcttaattttacttttccatttccctctctgctgctgtagtttacaagtcatcttggttcaatattccttccggttctgtaaaccttattttatattgattattcttccctattctttcctatctggacctaagctgagtctttaagttaactggtctttcactggcttcaatggacacaggctttactgttcattctttatctacatgttcacaacttaatggcaacttaaggttttgtctgtttctctgtaacacactaagaccaatattacaaggcaaattgtacaatttaaatagttaacacgaacagtaaagaagggaggtcagttaatttaatactcagatgaataagatacaacccaatgcatataaattgtttttctatttatcattatatattttctatttattattatgtgttattatgtttatagtttgctttttattcttgattttaacattagtttttttttctgattttatccctttctttgatggtacatttcaaccaaattattcaacaatctaaaataaacatcaaacaggtatataaagtatgtaatttaaaaatatttaagtagaatcatcatttcaagaccaaattcaggtttgatcataaaactctaggggacttcatttcctgaaacgttatggaaatcaaaatactttttctttcatcataggctactgataacatttaagatttataatttcattgttatatggaaacacaagttcattaatgacacaaacatgattttaaacgatcaaaatcaagttttcaagaatgataaaacaggtttatacccaggtaatttttttaaaatatactctattatgttaacataatttttagcagttatttttgatgccgggtatttttcatgcctttatgtgtatatgtagaagttgggagtaaaacatacccccaacagcatcaaaatactaaagatgtgcacactttctgtcaaaaggcacagaatttatcacaacagtaaaactcacaagtgtcaaaagtcaagtctgttagtagtcttgaatagcctccaagcattctaaaattctcagcagtacagattccagcctctaatttactaaggattattaaactgttttcctttcttagcctgtgttaatctatatacaaaatagtcaatcaatgagcagtattcaggaaaatattaataattatccataccttagagtctgaaaactaatataattaagggactttctagtttgctcttccagggaaatttttcatctcccttgcagaaattaattatctccaagcatgctatgagccgaaggtattgaagcattcagatgtcctggtggaagccttcaagtcaaccttgaaccatgtccacacagaacagctccactcagtgatgagggcctgccttaaaaatctctcaaatttgcaatctcattgctacttcctacatccggaacattggtatctgttgtctgattgaaatcccttctctaatctcttattccaatccactcttcatactgctgccaaagttgtctttctaaagcatagctctggacaggttggctgcctgtttaataacttccactggctctgtgtgacctacagcctaaattctaaattcctacctatgcagctttcgtcatctttgcatctacactacacctggctcagtaaatggtccaacagatgttatttaagcaaatgaacagaattgatgaataaatgtttttgagaaaagttcataaagagaaatcatagagtaattcctctatataacatgagagttagagaacaaattatggaaacttcattgtacagtataccacaattatcatacttaacacccattatcatatggcttagtgattaagtatgtgatcatggaattataactaccactgctattccactttatactgatgaacattattggatacataagcttcttacacatcatttaaacatcccaagaagctactaagctcactggtatacgtacagtgctccctctgatatccttgttttacttagactaagatcacccacagatgtataagatggcatgcatttacttatagcaatgaaattgcatctattaactgaaacaaactgttaactcatgtccatttccactcttgccacatgttttcagccttctgtaggacttacttgatacctacattgaagactttaaaaacgagtaacagaaacatgagttgtgtgccacctatgttagataatacgcttaggttcaaagtgtggcccatgagatgaagaccaacaaataacaggataattataaaaatacgtgctaggtcattatgctttatatgaagaattatgcttgattttcacaattgttacaaggtaggtattgtttttttccatttggcaggtgagaaaactgaagtaaagaaagattaatttaattattcttactgagggcctacttcgtgacaggctctgtgctacttggtacttaagtaatttggctaagctcacacagctagattcatacagttaccctcaaaccaggtctgtgtgattccaaagctcaactgataattaacagctggtaacgactaagccatgatactacttaactatccagaatgccactgcaaaaggaagaagcccaacttaagaaacacacctacacatcactatcctttatttcaccaatccaaatgatatttcttcccaacttatcagcctgtgtcattctggggcaattacataagaaatcaagttttaaaaatgaggttggcttcacatggatgataaaacagatgggatgcagcttacgtttatactcgttttacacggatcaaacaaacattgattaaataatgctgacttgtctttgtgcaacacagcactcatccatctgtatctatctgtctgactgaacgtttaacaaaacacaacacgggtcattatttttggagcttgtcagaatgctgacagcagtaaactcagtaaagaataacaactgaaagttggtgaggtatactaagatctttcatatttcaaaaaatacataaaactggttgaggaaaatcaaatttcagttatccatattactaagacaaagagatcatgaatgagtaagaccctaattgctggtgacagacacagttgctttgcctctctgttctcaggcttctcttgctgctgtcctcttaaggaagagtgagatggccaaaatgaagaaagagcaatgtagaccctgaggaatgtaaaagttgactttcacttcaaccctgtattttcggtcagtccaccctgaccatgcatcttttttactataaagctaagctgaggttacccaaatattaattattcaaaacaatttgaaataagcacctttgttcttaatggactcaattccttcttttgggtctgctgctgttagtgtttggttttcctgagcttgactcctagatatgtctactcaactctgtccacccaaataatcttccatgggatacccttgccttcccagcactcaatctgaagttttaccttcccaagctgaaatcctggccaggctttcttcagtctccgttgtggagaattttgcaagttagaaataaagcaagctagatttatttaagtaaaagttgattaatacacttttatacatgatacgaaatacataaattatcacagaattcacaaaaatgctacttcgtcgtattttttgtgtctccagccaatcaaaaagcctcttgaaagacagatattggatgaaccccatatagcgtctaaagttttaccaagatgccgcaccattttacattgcttccctgcctgcacactgggcacttgactcctcctccccaccgcagcttttgactaaacctttctaacgctaacaacagatcttcaactcaaaggctttgcttactcagaaaaaatgacccaatagaagaaaaaatcctattgtgagtgatttaaagaacaacgggaaagtctcaagcagatacttgctaatataaaacactttgcatttatttagtctttaacttgatggtctgaaagttctaatcctttttatttgatcaactagaagtttatctcaaactaggtaactgaaaaaataagctatagcagatggattagaggtttgcattgtattctcgacaaaaactcagaattaaaatataaatatatccaatagttgtaactaatacttagataacatttactatgttttctttgtgctttgtacatactaactcatttatcttcacaaagaccctagaagtagttgccattatgattacagttatgtagatgaggaaactgaggtatagataagacaaataactttctcagggtcaaacagctagcagggagagaggccaggctgggggtccacatattctggccctggaggctgagggcccagccaccataagatgctttctctctagttaagctggagaagattccttgaaggtttcacacttgcctttcaactattctcttgaaacacaacgcacagaaggttgggaacaatctgtgtagtactgctgaactctatttgtaattctaaactccaaacaagagagtgatcatcaatttgcacatcagattacagtcaccaagtaaaattatatcctgatatgggagtaacctttttcaataatgctgaagtcattatcttaaagcaaagtcctttaatcattctgcaaaattcaacctttttacccagaagaaaaatataattcaaatgtgcaaaacaccatacaatactagttgctctgtgtttcactttccctcatcccgccaagagaaaaacctcaaaatattccctttagaaactcatcaaagagaaaccacaaaaaaagatcatcctgtttttgtgtgtttttaaaacaactaacaaaaatttaattatatagaaggaatagaccagttacttcactcgtcaaaccatgggtcagactaaccattctttttacagggaattgaactttcaatgaccttaacttccaaagaaacagtatcttttcacatatctccccttcagtaggctcatttggttcttagtgtggttggctctgagatattctcaagtcctttctgaggtttagaagagcaatctaccattcactgtgtattctgcaattatgccttttaaaattctcattcattgtctctctcttctctgtttgaaaatggtaaattaatatatgcccatttggaaaagaccacgtttgcatagatgggaagggctatattttgcacaattagtaaaagcctgcaattggcataatgaatactttcttcaaagagaagagcatgagttcagttgaatcctatgatgttttagaaactgaaatgtgaggaaggagtggaaagtccagtggtgaacaaaatctggaagtcagagaacagggtgttagctttctggctgcccctggttagctctggccggtcaggtaacttgggtctgtttgctctgtgttcccttttcctcttaatgtcaacctagtgtcaggtgtgtgtcctcattttctcttatctctctttgtccaattagttatcaaatcttactgagtctctctctgtaagagcacctctgatccaggccaacattagagtgtgaaggattgaaataaagatttttcaagactctcagtattaacaaatgaatggatgtgggagtgccccacctttagtagtagaaaaggcatagaaaatgtataaatataccacactcattgaagtcatcaaaaagtgtttcagtcacatatttttgtacacagttaaaattctggcttcagataagtgataaaatgcatcagctttacctgttgtctaatggttgcatttgaaattttgactctaacatactatataacaaatacgtatagaaaattacttaaagtaataatatatattattagaactgacatgcagggaacaaaaaggataaactatgctcatagtaaatcattcatccatggcaagtgagtaaatatctgaggtaaacttttgataaacaatttattctaaattatatcatagtactaaagatgaattagtttatttcactgaggaaaccattgattcccagaagtatattagaattatcttaatctaacgtggattaaaaatgatgaaaaacaacaacaaaaccaaaaatacttaattcttttttttaactcagtaggccaacatgaggtactctctagaattcagataaagtgttttactattttagtgtgtgactgtagaaaagattatttttgagagatcgttccaaataagaatccaaaaaagaacatacaactttaagattaaagatttaaataactagattttttactatatacttttttaaaattttttatttatcttttatttttatttttattttttttgtggcagggtcatgcctgtccaggctgaagtgcaatggcgtgatcttggctcactgcaacctctgcctcccgggttcaagcaattctcctgcctcagcctcccaagtagctgggattacaggcatgtgtcaccatgcctggctaacttttgtatttttagtagaggcagggtttcgccatgttggccaggctagtctcgaactcatgaccttaagtgatccacctgccttggcttcccaaagtgttgaggttacaggcgtgagtcactacacccaacactatacatggctttttaatatgccaaacattttcctgaatattactaaatgcagaagaaagacatttctagtttccaaagacaatgtgctagaggaataagatcagcgatatgtgttaatcctaatgttttcatttttagctatttatctcctacatcagataaggtgaataataagaaagagatggacagatttataggtgatgttctttttttatttcttcacatctttgaattctatatagttgatgttcttaagaatagaatgtgtcattggaaatcactttacaaatacaattcacagattagaatttctgatgttatttgaaaaagcaaagagtattaaagaatttccaggcagtttggggcaagcaaatgtattagaaagttattaaactgctttgtttaaatagacaatgttgactgaattggtaaaatgtaattacgatgacttataagaagaagtcacttgatctgcaaatcacttataaagtatgatatttaataattaaagaggatcctggtgaggtggcatgtgcctgtaatcccacctactctactcaggatgctgaggcaggaagacttcttgagccctggagtttgagtccagcctgggcaacacagcaagacccaatctcattaaacaaaatattaaaataggttatgcacacctagaaacattaaagagtatggcaacattaaagagaatattattgagtataggtaacagacaaaattatctagcaaatacaatcaatgtgcagcattaaacactaatttacggtgttagtaaattagtgttttagtaaattaggaagaattaattcacagctgcatcctttcttttccatggataacaaggtcccagtttttgccaccaaattaactagatgaatgcattaattcctcactgctctttgaaaatgctgacacatctgtatagatcccaaagtattaagcgaaaagtacctgatgcacagttattactaaaagaatgctagatgttttgccttctcttgcctctaccctgtgacttgtataagaacatccctgatagaagactatcttagcctccaaggaatatctgcattctccttgatgctaacggtgccttttttgatactgaagtataaaactgaggcaactgctcaatttaacaaataaatctatttctgctctcctacttactatataacatgcccatctatgtaatttgcaaactgatttacttttccggcagagacaacaaaaaagagcacagctgcatatggttctcactttttgcatttcatataatagaaacttgaccactcagaaaactcagtacataagtagattcaaaagaaaaaacaaattatgaatgaatagcttggtttcacaattgttgtgcgactgatattacaacatcatttaagaaacactataaggaaaattgttaagataaatcatcttcatttttaaaagtcggattagttgagcttaagtgataacagtaattcttttaatcaaatatgaaaatgtctagcctaattttaaacatacgatttttcttcctattatttttactttgcatcctaaacatagatgtattttaggctttcatcattgctttgcttgtcatttaacagaaagtttctttattaagtctttgtttctttttccatatttagtttcagatgcaggtggagggaacagatgaatttctaaattgaaacataaattaacttttgttaatgttcagtcaatgcatttcaaatctcattttctgattcagaaagagataaaaattctacatccaaaatgaaataagaaagagtaatgttttctcccagtctttgtcggaactcagaaaatcccaaataatcacttaaaaaactcttgtaccccatttcataccaaatgtatttagtacaactatctcactaaaaaacatgactatccacatgtgccttttgggcacagtatatataccaacaaccccttgccattaataccattagtgcttgcaggtaaggtagcaatacaccatactaaatataggcttctaatcaaagaagtcacacaggatgatcattaatacttatatccatggtgctcaggtgtcttagaaagtatttacaatctaaagtgtcagtatatttgtctcttacatgtgataaaactagaaaggctagaacaaattaacacaatctagaattttagagtttagtatctttctaaactaaaagattactctcaaagattagtatttttaaatgtatattagttttacattgtaaaattagggactcttctaagttaaatattagaaaaaaaatcagtacattgatgatcttatgtattagacctctggaaaaaatggaatcacttgagaacactgctatggggttgtgatttatctgatgttgtatattttgtatttagcatacagtgaattttaaaatgtatttgtggaatgaatagctaagatacattacaggtaggatacacagcaacaattacttttaccctagtaccttagaactagttaaataaatttctcagccaaaggtgtgatgatgaaacaaatatatattggaatagaccagagatataaaaaaaaaaatttaaataaacagaatggctcccagctcacaagtggctacaacccaattcataaaagccatctttgactttttgtgcatctgaaattcattctaagctatcacctgtgacagccttttgtactgtgttttccaatttttacatatgtacttaatatttggaagtaacacataatggctacttgccaatgacagttctgtataaactgtattacccaattttctgcacagcagtatgggtttatacaattagttggctattttaatacaatagtttttttcatttttttggtttgtttgaacagttgtgctccccaaagatctcaaggccacttatgttgggagttatagggagaatggaaggaatgtgatcagatggaaggataaatattccagaatggagctctacaataggctgagtttgagttaggtagtccctacatcccagtttacacctactgtcccagcgtagttattaataggaccctttctcactctcaaagtatcccagtttaggcaagaaattacatggccaccccaaggtagagctggttctacctaacttcctcatattcacatctatatctaggcaagcttcatgacagtgtcataaccatcagtcaggcatgtacatgtacggggagggaaggcgtgcaggggagcaggagagagggagggagggagggagagagggatggggagggagggggagagagagggagggggagagagagagagagagagagagagagagagagagagagagagacagacagacagggggcagtctctgctaaaaagtaagtacacttacaaactatcacatggataggtgggtgggaaaaagtaaagagaaatttctgcagtgcaatacctatctccaattatctaacactattgatgcagcaatgagatactgaatccagaatgagagaaggtagctgaccttaccatgattcacccttgttcaccttaactatggtgctgcacacaagagagaaaaaggaagaaagcagagaatgtgtttctcagcacacatttactgtgctctctaacaaaccaacaatttagccctttctgataattgctttttcctccttctaagacagcattggagatggaaggaatgtgcagtacataagctggctggatatgtattcaattgtgattggatatgtattcaattatgatcaaagtaaacgaactaattttacaaactgataattcattctatagacatgatttttaatcttgtatatcacctataatattttataatatttaaggctgtgattggaatattaaatgtaattatgtcataatttcttttttaatttttaatgctttggaagtaaaaccatagacctattgtttgagtattacacaattcaaccatgatacgtgtctccaaatgtaatataatctaaacagtaaaacataaattaacatgtcctttaaaaatctgtgtattaacatatctaaaaaaatgctgtgtcagttagtaggagagaaagcaagccacagacatgcagacaatggagggccagggaggacgatgaccatgaaaatctggtcctctcagaatgacggtagcatttagacgtcacagcttcattacatggccaccaagaccacacaactaatgcaagtgaggtttccagaaaacagatctctctcaagttttagaactaagaagcaagttgtaaagtgaccatatcaaggtattctcaaggtctggaagcctgtcttgggatcactttgccttctctacctggctcaattcaccccactgtgaagtcagtctttgattcatccatttcctggtgttagacttcagatactaaactctgtcagaaagccttaaaagtgaaaaaaaatatttcccctgaacacatgtatacaatcatttaaaataactttgaaaagcttggaaatagccttaatataatagtagattatatgaaaaagtgtgaagctattaaaattgttatgcatctagtgacgtggaaagataaacttttactgttaaagaaaaaacatgaaacagtacttttgttaaaatatatacatatgtatacacatgcactgcatacatacatgaatacacacacatataaaaacctagaatgttatacaccaatgctatcagcagttatctctgagctgtgataaatgacaattattttatttccttatgtttactatccatgttctttaatttttccatttatgaacattgaactactttccaggaagagggaaaaaagagagttgcagaatacttttcacaactgcacatgtgacttcctcttgtcatgtcagaggcagaaggagcagactgtaggactcaacactctggaggggattttgtgaaatccatagaaaatttttcagctggcttttggggtccatgaaggtaacttcagtgtagatttatgaccaggaaagaatactgaagggccaacacaagactagactgtcttactctaaactcaccaaaggatggtagtgagaaataatcaggttaaattacttctgattttgaggattatgatgacaatgaggggtggattatcactacttacagaatctcatgtaattcttaaaacaaatttagaggtatcttagatattgttatctccatattacagataaagaaattgaggcatagaagggttaagatactttccatgagtcactcttggtggtccataaattaggagaactgggatgtaaatgcagagattcctgactttgaagacagagctcttaactactacactctaatagatacgtaaattataaatttattatcatggagcataattccttatttaaaaactgtggacagtaaggaaaatagattaaacaccagatacctctgccaattttggcttaatgatgcattcatcccacagttgttattgccaaaattttttgataatgaaagacaagccacagctttctataatatatcgttagattctaacatgactcctatcaaatccaaaagagtgggaagttaagtataatctttactttaataattgggaacaaaaagacacatctcaagttctccctggtttctacacacccaacagtgctgccccaaaaccctcacacaccataaattctgcgggaaaagagagaaagctgatgcacattcattccttagaactgaatagccataatgcagcaaagggtagagctgtattggcagaaactactaagaatggtgagagaccaataactcatgaaaaacaagtctacactaacagttttaatgactattctaatggtttaatggatagcactttaataggatttctagtagaatctgaaagcttctgaaagcttgtcttcaataaatctgtcattaacaaagaactgcattgcttaactacataaccatagtttactgagtctgaacacagaaaaagtatagcagttgtcatcctgtattaccatcaccttttcaagtattctattaactactgtgagagagacagctacaagatcaaaatgtaggctgccagtgaaagaggcatatttatactaaggggatgcagtagacattaaataaaatacaacagaaagctcacaattatagcttgtgtccaaagaaaaagctgaaacagtaactgtaatccaaatacacagatatactaacaatgaaatttcaaaaactagctttagttctctttgaaagagtattaaatgttttggggtgatttgtttttgaatgcctattgcactctgtgtctacatttgacttattttgtattatgttgcttcctgtactgatttaatgttctttaaagtcaggaattgccatgttgtggtgctcagggtacataccaactcaatataaatattggattggctataatcagtcctagtgaataattttaaattccagcctttggctctgttttcctctgtccatgtctgaggttctcatttctgacttttttgcactggaatatttcttgcttggagagcactttcttatccttttcttttttttttgcttctaaattctaccttcctttcaacaaggttcagcttaaatcccactctcccaattcattactgcctggagctttctcttacatgcttccatgtgtgccactatcatgtgttacagactggagcatccatttggcaactagctacgtttagccttgtagcatttcttcttgtaaagttgtttgaattcattaccataacttatcttttcatttgacaattctttatttccccaactctatagtaagtttctcaatggaaatactgtctggtatatatctgtgtagtctagaaaatggctagcccagtgcatgtaaaatgtatgtaaaatacatttttttttttttgtaattttaatcatttcttgtctcaatttctgtgaaagtctttcaaggttgggaaacttatttctttcggaattacacgtagtcttatatataccaggatcacaaacctgaggataacagactgatgcattcttcgagtatgttctatcaatgctgatagctgtaaattcatagactttacagcaattatactgattatcaaaattactgaaaataacccattggctaagctatgaaccattcaagttgtacaacttgaacaaggcctagagtatactggaagaataaaaataccttctcagatccaatagtaggcaaatttgagtaaatatacccatgctaggagatttatatatgtctgtctggtgataatgtccttgtaaaaatggctccttcattcaaaatcaaaagcattatcacttgaggcaggagttcgagactggcctcagcaacatagtgagacatcgtttctaaaaaattttaaaaactcatcacaaaagatggtaatgcacacctgtagtcccagctacttgggagcctgaggcaggagaatagtttgagcccaggagttcaatgtcgcagtgagctgagatgagatcatctcactgcactccagtctgggagacaaagcatgacccactctccaaaaaattaaaaaaaaaaaaaaaagaaaagaaaaacaatattattaatcaagctattcaataaaagtaaacagaattttattctgaaaaagacaatatgtttgaggtcatttaaaacacctattgtttattaagaaaacttattaagtgatagattcagtctttacacagagtgagtcttatttactccatttcaagggtatgctttgaaaaccaaacaatatagcgaacaaaaaacaaaaagcctaaacaatttcataaataacaatatgggtaaagtaacaaacataaatggcacgctctacaagatagagcctcttttaccaatataaatattaaaatataagcaggtcatcttaaccaatgatttacaataagggaagaaaagaaaaatatctatatgattctttggcatctcatatttctttctcgggggggcatatatttcatccagctaggggaattttggatgaaattataaaacaaaatactatgcctgttaactgctcccacagcttagagaaaccctaagaagttctgccagggaagcataatagagaacaaatgctgttccctaatcttatttcacatacattcaagtaacagaatatgagaaagagaaacatgagttttccctacagcgggtccaaaaatctgagagtctgaaggattgatttttctgtttaaaaaattaggaaatactttgaaacacacattttagacagttgctaagacactaactgccctgacctactgaatttccacatctttgtatgtattgagtgtcagaaaaagaagaaatcccatcacccctcacatggtacatgtaacaaacgtagacaaaaatgccagtcccattaaccatggagtaaaactcatagctgcataccaaaatcctgacaaattctagttattgtggctttggttaagtttggataaaaacactaaaggaacccttggactcagaattcaagggcaaaatttatgcatcatttatttttgtactgcagagtctagcaaagtacctggcacattgtaagagcttagtaaatatctgttttatgagatgagctgaatataaagctggaaaattatatagacttttaaagaaggagcattcatgatcttgaaaattgtttcttaggtagctaaaatttttatttttatttatttttaaattttttgtagctaaaatttttagaattggtcttcttgttctcaaggccatttgggagaaatgagcagctttgtttcaaagttcatctgtttattctccagcgaaaattataatccttggtctgtggcatcacaattggttgctgtgggaatgattatagatcaaaaacaaaacgattatatcccttttcaagagcaaatgagtaccaagagcagatgaagacttaaggaaacaaagatgttcttttcatgcaaatatttttacaatacaactgtggagagataaatactgaagctggtagtctttatgaaatttataggcagatttttagctttggggaaagacagctccctttgccctcagagttagctttgagacatgaatactacagatcatttttctttttttttttttttaaaaaaagaaaatataaagacactgagagcgtaggaaaagtgagttctgtgatcagtattcccctgttgttttatttcaggcagaagaatgtcttcctcatctgtgtacaggatcactgtcagggagcttgatgtcctgcactgtcctggcaatatgttgcccaagggaggtccaccaaggaaagccaaaggtgaattctccacctagaaagaggaccatgcccataaagttgctgttcctccgtctccaaaagacttctgctgcagcacagtagtagttaagagttataacctaatgaagcatgcttattcatgacttgataaatgatatctctctatatatcatgtgactatgcttggaaagtgggagatgcaaagagcaaactagactcctccttctttctctcttttgcaggagatgcagagaaaaccaacctcctccctctttctctcattccttccttctctccctctctcttctttctggcttttctcttccttctttctttccttttctttttcttttctttcttcttctctcttctcttctcttctctctctctctctctttctttctttctctcaacttatgcatgtattaattccagaaaattttaccatgctagtcacaggaatatcctgataaacgagacaccatgaagaagctttcataatagcagaagacacaaaagtaaaactgaagaccctgtaatcccttgcaatgccatggattcaacacagcaaacagcgaatcaaatctgccatatacacagtgacaggcacctgtatcaccctaatcttggccttgtactcaagcctcaagctggagtttggcccaaattgacaatggcattttcaaacaactcctcagtgcccttagtttccctccatcaaatgtttaaaagcaatacaaacaaaagaaacacaaatattcaccaaaggtagaaaaaaaagcccagtggtcttcttgattctttataatatacccacttaatatttaaatataaagtacattcactgaactttttttttttaaatggtgaatttgcccgggcgtgatggctcacacctgtaatcccagcactttgggagaccaaggcaggtggatagcctgagcccagtagttcgagaccaacctgtgcaacatggcgaaacctcatctctacaaaaaatgaaaagttagccagtggggtggtgtgtgtttgtaatctcagttacttgggaggctgagatgggaggatcatctgagcctgtggaggcagaggctgccgtgaaccctgatggtgccactgcacttcagcctgggtgaaagagagagaccctgtctccaaaaaaaaaaaaaaaaaaaaaaaaaaaaggtaaattttatatgtgaactatattgcaataataaaatgatgaagaaaaacatataaaatatatcacacaagtttatttctccctaaaactgccttatttcttcccataagtaaaattcctactttatcacaatccttgtaatgtttataatttgggttctcacatagaaaaacaaacatccttaacgtttcaagttaacatgactttaggaggtaatatgatggttgtttatttttcagaaaacatttttatgtgtttgtttttatctagggagtctacttagaaaatgtcatctattgcataatgttagatgtaaacttgcagagacttcagccacgtcacttaactgccctgaaaatgtcttctctacagtaaaataacagcagtgaacgaggttagaagattctagaaatcctcaaatataacttcacagtagaaactttgtgacactgaatttaaacttaaacctctaaaattttatgaaggattttttaaagataataggatgatttcttgagctgtgacaacaaggatcaatacagaaggaatagaaaaagaacaaaaatggaaatcaatgcccagttgcacggcaacatccaccaactctaacacttagactgaaaatttttattctccttgtgtctcaacagatgacaaggaggtcaattaattactggtagtgggtggtaaaatcttctaccttcccttatgcagcaccctaactgctcttaataaaaagggaggcagcatttcattgttcattaactatactaattatagcttctcaatcactgcagccacataggcactcctgagttgtagaacggcaatagaagagactcgacctaagcctgcagggatgggagtaggggaaacacagcattgagaaaacaaaaagggaaacctgacatcagaatctgaacgttattacatttacattaaatcatgtttcataataaccagagaaacagaatttcagcaagagagaaagaatctaaaaagatcgtccagtccaatcacctaaattatgtttgagcttctgcctcgtcaatccggctcaataagttatatgccacctgacatactgttcattttaacagaactaaaagctggagcaaaagcaaacaaaacaataataacaataaattcttaagctaatggaaataaatgtaggtaggcagtggttttgtatcctcctgccatcttgaaatacggcaagcatcttctgattgtacagtaacagctcctatcttttcaaatcatttagcagcttttgtatgaaattaagttgcagaaacatgaaaggattttgcatatatgaaaaggtgtttttagaatcttaaaggtgaatattactatgtatcatattaaaagacttataaatcataatttattgtggtgagcaagtttccccttcttcattggtcttatctaaatgaaactggaatctgactcgtgatatgtagtgagaagggcaccttgccagtataggtctcacttttttttaatcttcagggttagacaagtaggtagactctggtctataactgacaatgtcaaaacaagaaacaagtcaataccaactatcccctgtgagagttaaggctgagtctttacacctttaaatcccatcaaccatctgctttttttttccttgattttatttacctagatcaagatcagaagtcaaaggcagtcactataatataggtagttatagaatcaatctgatgaattatttctagcccaactaatcaaatatatttttctgtttgacaagcttaggatggaatgctatttgtttcagatataaactataatcctttcatcatcttcaaacttgctaatttttaataaaaattaaacaagagcatgaagcgggtggctgggtataaaggttcctatccaaatcatttaaaactaagtcgttttgttgttgttgatagactgtctctgatgttgaaaagcaaaaataaaatataattataacaaaaagaaatttgggacaataatccttccttggggtcacctgactactatgtgatcaccttaacagataagttaatgacaacaaattttccatggtgaaaactgtggtgaaaggaaatcaactctcagaggcaactatttatagtggtcagaacattacccagacctcagactacacgggttcatatcctagctttgccatttactagctgtgtgaccttgagtaagttacttaactttcatgtggttcaacataccttctgtaacatggggagactaacagtacctacctggaaggactgaatgagttaatgtttacagtaatgcattccgaagaatgtctggcacatggtaagtgctatacacatgtttgctatcaccatcatccttgtaaagcactatctagactctgaaactctatggaaagactattatgatattaaaatgtgcagtttaatactaaaaaaatgatataaaaatactctgttaaactggcagaaaataaagaaggggactgggaagaaaagggaaggaaagaggaagagaaggggaataaaagaatgagtgaagggaggagggatcatgagagaaagaacaaattaaatcaggggtgtctgtgagccactggttgaagtttagaggactgatgagtgcctgctgttaaggaaatttttttagcaagtgatatataataaagttctgattatgcttcatgcatgaacttttaagctaaagccaaatactctgattgctgcatctgtgacgatggaaagactaatgtttcccaaggcctagccaaaactgcaaattcatgtaatctcttaatgcttacatccttcactttcatctacactcccaaagcatggtggtgtgcccaacatttgttttttcaaaaagaatgacaaactgtttagccacagtagaaaaaccatgacaaataatactgccactaccattttataattttacaattaaatacataaataagtaaagtcatccctatgatgctgggttacatcaggctctaggcagccttgttccaatctcttcttgcagcattgttaaaattttccccgaaagctgttcccagcagtgacataaacatagacgtactcatttggtccctcaggtacttggagtttcaggaggaattgtaggaagtgatttccatgacttttctgaacatttttgaaatcacttggttgcagactccttcctatattgttatgacctttcaagggtgtaatcacctttcacacctcacctctcagcagcatgaccctgagctgcaatgacagtcacagaatatgttgggaacccctgagcaagccacgcttcttctcatctccatgcttttgcatgcacagatccctcagcctgggggcttgcatttctggcaaacttcagtgactctccaagtcatgggtactctgggaagactctcgtcaatattgtcccactcccaagattaacttaacaattattttttgttttgtttttttgttttttttctgtttctcctagaagactatggactcattcaggacagcttatttcttgattatttttggttctccagtaaatgttaaacagatgaaggcattcaagctactcctcttataaacaaagaaactgagatcaggagagttaaataatgtgtctaggggcattaaaactagcagagacatcaggacagtttccattcgtcagtgaaaatacctttttttgatattttaatgtggatataatttccagaaatgatattatgtacaaaatatgaaaagaactctgtagttcttcataattaccctccatccttgtcaccctttaccttcccctaattgctttcatagagctcctttttggaagaatgagaagagaatgttatagaagataaaaatcacttgagaaaaaaaagtcatgttaagtgactgacagataggtcatgcatattgaagttcacaataacaagagccacttctgttgaccaagcgcagagggcaatgggccaggtgcctaacatatattcatcttcataacagtctcatgggtagatactaatcttctcatcttaaataagagaaccaaggttctgagaggtaaagcaactggctcaggatcaagcagcgtagctactaattggcccagtcaaaatatgaaccttgttttccctgacttcaaggccctccccagcatccactatggcatccctctaagtacacacttagcattccggtgctaaaatcccaattttactttgaaataaaaatgcaactcaataaagagtgtcttttttcagtccttgctatggtctcttggaagttgaaagcttgctttggaagcagagacagagttgtttcctgagagccttgggctccacatgggagcaggtgaaaagacattttggagaatgtccagtgatggtcaagggccaattagttatagagaacttgtatgagaacaacgactgagaaaaaatgaaagttgaaattgtatgagaataaggactgggaaacagaaaacgagttatgtgagagtcccttaagacgggtaggactcccacaagaaaaaaacaaaaggctctactatgaaagatacgaagtttaatgttagtaaagaaaatgtctgaggttttttttttttttttaatgtgggtgaaagaacaaacattttaaaagtctaagtagaactaagctttggaacttgagaaattacttgcactttgagttttcacaactatagaagatcagtaagaaaaaaagactataagcgcatagacatacgccctgttttggatgcaatgtttcttctaaggtgagctgctgtgtctttgtgttctactagatttgtttataagatgccaaaagcagcccactgggaggggactctgtactttttcattttacttggtgagactggtccttaactgcagaacaaagacagcatgttctcagatggccgactggtaggccaatctttgctataaaagcggctcagggactttattcagtaggtacttttgagttaaatctgagaggtctgcattaaaatgtaatcacttctgcactgtctagagatagtaatagcctattttctgagagaaaagagcctgaaaataaggcttcactgctgatagatcaggtggggatgtcgactggaaaaagcagctctttacagcaggacactctttcttctgtttgctcctgttgttgatactagcaattttgatcacaacaaagagtttctatgaactgtaaatttagttagaaattgatccagacacacactttggttaatcacctgctgtgtgccgagcggtgagcttgttaccacgtggccaacagcataccgagaggccagacacctgaccaaaacacctgacccagagaggcttgatcacagcaaatgactggagagtaagaaagggcaacataacaagtgataattgcactggtttaaactagcaagtttccatttctttcagtcttttattcttcttcttcttattgttatgattattattattatttttttttactgacatcagcaaagccctaagggtttggcctgggataggaaatggtagggtttcattgattctaagacatacatttcctttccacattctaacatctctgaaattgatgtgcatcttaaaattgatggcatcgtgcagttataggggtgatatcttttattccttagtggtacatgcaatgatggagtatcttaaaattgatggcacctagatgagataaaataagtaatagttactaagactactgagtactggtgtcaggaaacctgataagcatgtatgtgtttgtttttaatgattgtatgaagtaagtactatgactgcttctttatatagagatgaacaaactaaaatacagagaggttcagtcatttgcttaaggtcacacagtttgagctaggggccaaactggtgacctgagccaagggcctgtatacttagcaactgtgtcataatatttattcccactgctggctcaacaagtagaaagcccggagtggcaggcagagaggtttggacccaatctgagaagcagaaaaactgccatgttcgtaaggaattgggcaaagactctcccacacccacctccaatcccagtgtattaggagattctgatctggaatagtaaatttagccattcatcttcctcaatttcatccatcccaggtacaaaaatgttgttactgctttttatttcacaaaatcgctcatttttctcattccattaccaaaccaccataatttgttctcaacttttttaaaaacaatcttttatctcttgtgactcatatgtcaaaaatacttagaaatggaggccttcccttagaaatggaagagtctattccactcttccactttgcataaaagatgaaaacagatctctgtcgtccaccacttccttccttcaagaaagtgggggaaccaccttcaagaaaaaatccagtgcattcgaagttggccaaaaaaaattgtgtgtgtgtgtatgtgtgtgtgtttggtttcttgtttttgtttgtatgattcttgaatacatgtcccccctcatgagcttacacataaattataaactaatagaaagcagatatgacagtagttttgcattataagtgctcagaggtttacaaaacctaataatgatgactgttttactaatgatggttctgcgcctgtgaatacactgtggcacatgtggtcaaatataccaagagtcttttccaagggaaaatagaaatgttttcttttgtggtcattgcttagatgacagacaatttttgtcccctctgcggagaaatacaatgtttactatcaggagtgaacaaattatctatggagaaaagcaatgcgtccttagcatgtcatagagaaccactgggttttcccaggaatagtcatgcaatggaaattggtaactatgacattttcacagaaattttaaatatcaatattttgatctagtttgatactaaggtttctgaactctatcatcagggcatagtaagaaataaagtgtgaaacatttaagtgtttatatcaggtaagttaaggtgcagtgaagaagaacaaaacaagatgaatttgtgacctggttttaccacacatagtaggtgtgtgaccttgggtaagtcacttctttctcagtcttatgctccttacctctatgatgggagagtgaaaccacatgatctctgtggtttagacagctctaaatattaaaaaacatgacctaagcaatgtttttaatgtctctatacgtctcaacactgtcttgatgtatttcattattcatcaaggaaatatatttttcctttatctgtcttactgagtgatgggaagattttaacttactctacaaaggtgtaatacatattgttataaaaacagaaggacagggctctgatatctgaaatatttcatataaaagggtcattatcatcatcacagacaggagatgtgagagtgctgccatgagaacaggaagaaactcagcacatgtgggtgctgaatggtgggagacatgtgagcactgagactggagacagtccacatccagagacggcagcaaatgtgttgggactgggctttgtgatgagaacaaaacagatcaaagaggccttcttcagggaacacttctgtgaaccacagagtttcttgtccctctccaatggcaacagaaagattgctccgagttaatacatagctttaaggtaatactactaacagagctagtgctgactaacttgaaactagatgtctgatgactgttcatctctgtgtaactaccatgacaggatggactgtggtccaaaatgtgacttgtaagtgagctgacaggaactcagaaaaaatgctgttgttgtaactacttaaaaaggggttattatctcaacccacaccacaaaatgtataacatctagaatgtacctgaagtagagtatgtgatttgggacagtatttctattagaaaactgtaccttgaggaccacattgggaactagttttacattttctctaactttatagcttttcttgatagtgaccactgggatgcccattaattttttttattttttttttactttttttcagacagggtctccctctgtcacccaggctgcagtgcagtgacatgatctcagctcactgcagactcaaccccttgggggtcaggtgatcctcccacctcagcctcctgagtagctgggactacaggtgcatgccaccacgacaggctaattttttttttttttgtagttttgcagagacagtttcaccatgttgcctaggctggtctcaaactcctggactcaagcgatctgcccgcagcgtcctcccaaagtgctgggattacaggtgtgagccactgtgcccagctgggatgacaatttattacacaaagacatcatcaatatcttttaaaatgtagattctgaatcagtagcagtggggtagtacctataattctacatttctaacaagttcccaggtgacgccaatgctgctggtctgtagtccacactgactatgagactaccagaacgttcatttctcatgtgcctttcccttgataaaatgcacttcactcctcttcctagttccactaagagtgccatcttctcttcaatacctttctcaattctccagatcattatgacctttactgaatcccaataacattccagcacttaagattacctccttggtgtaattctcgtttgattgtatatacttgtctttgacaactacaaactccagaagtacaggtttcttacaacttctatattttctcagcactgagcacaatgcttttctgtagtactgtagtggataattattagttcctcctcccagctcacaagcctccttacacagaaacttcgctctcccccatctaagatctgtatgagtggactgttagcagttacgtcccaatgtgtgtcaccacaacaaacagtcaattagatagagttcagagtttgctctctggcatttaaaacatgactggcaagtacaacttagtctctttatggggcctgtacgtaaatgaaaatatgattacagaccatgttttctgtgcgtgggtgagaaaaaaagaagacgctggcttgtataaggggaagaataaagccaccacagagaaagcacaaagatgaaagctccagagaagatatcaggaaattgccacagcccttcagttttagatgatagttcttaatgtgtacctttactgttagccttggccctataatacatcaaaaatgctcttctgtatttccttgagaatttctaggggctgcagttgcttacgatctatctagtctaaataagatttgtatatatatgactgtgatgatgcctactgattaaattttaaatatactagtctatatgctatctcagaaaatggtgaaatgaagactgggggtcatgttctgtaatacattaccctaaaccaatgacattcctcaaattgaagtctttggagcacctgcatcaaagtcacctgaagagctcttttaaaatgcagatttgtggataccacagctgacctattaaactagcatttctggggctgggaccaggaatttcaattttattgtgtctctgccaggttttggtatcaggatgatgctggcctcataaaatgagttagggaggagtccctctttttctattgtttgtaatagtttcagaaggaatggtatcagcttctctttgcacctctggtagaatttggctgtgaatctgtctggtcctgggctttttttggttggtacgctattaattactgcctcaatttcaaaacgtgttattggtctattcagggatttgacttcttccttggaatttcaattttaaataggcaaccaaatgatctgtaggcgccagcctaagattttgtttggcaaggtctacacaaattactctgatttaaagattcaccagcctaatatatggactttaacagccataccaactttaaggaggactttcttccctgcattccagatgccattctcaaattgagactacttaaattccagcaggacttttcagtttcatctcagaaaatggacatctaaagtgtttataaagacctgcagagatggggttacactaatttatcaagtccattcttccagctttcactaaattcactgttggagttcaacggcctttacagtacaggaagtgtctcataggatctaataatactgtgctacaatttaacctacttcctcgtattctgacctcaggatcagtgcaaacagctttcacgcctttaacctgttttagtcttagaatcagagtaaaaaaaaattagcttcgtgcatcttacaagttctgagtaaacatttactcacagtgattatgccaaaataatcaggtgtttgaaagcaatgtgagttttctttcctccattttctttgctgaaagccagtaaaaatctattcaaatttatgtagaagataataaacaatttttccccacaaaatgttgctctgagcctaaatttttatgttgaggtcttaatcctattatcacagttgaatacaacacttaaacatctccttcatgccggttaaggcacagtagagtcaattcatgcccagggagctttaatcatggatcatcatcatgaacatcagtgaagagtctatgtgggctatcaggtccacagctaagcctactggggaagctgtgcatagcagcattgccagcatgcagttcataactattttcaagaagcacttctgatctaatggctaaatgaggatcattaaagtatctttacatgtagcatttcttgaaaattccacatttaaaagaggccagttattgcattcaatagatgcaactgagattgcttgagtgatggttttatagccatgtgctgcataatgacatttcagtccacaacaaaccacaaataagagactgatccataaaactataacagatctgaagaaattcccatcacctagggatgtggtagctgtcgtaacgtcctagcacagtgcattactcctgtggttgcagagatgttggtgtaattaaacttattctgctaccagtcacataaaagtcaggcacatacaattaggtacagtacataatatttaataagtgaatatgttactagtttatgtgtttactacagtatacattttattgttattttaaaatgcactccttttattaaaataaaaagaactttaaaacagccttaggtaggtccttcaagagttatccagaagaaggcattatcatcataggagatgacagctccaggctgtcaccctgaagacattccagtggacaaaacgtgaaggcagaagacagtgatattgatgattctgactctgtgtaggcctagattaatgcatgtctttgcaacttagtttttaatcaaaaattctaaaaagttaatataatttaaatagaaaaacgcttataaaataaggatataaagaaaaaatgtttttgtatagctgtacagtgtgcttgtgttttaagctaagtgatatcaaaagagagtcaaaaagtttaaaaattttataaagtagttacagtaagctaaggttaatctactattgaaataaacttttaaaataaatttggtatagcttaagtttatagtgtttataaagtctacagtagtatacagtaacgtcctaggcctccacattcactcactactctcactgacacccagagcaactaaaagtcttgcaagctccattcatgctaagtgtcctacataggggcaccatttgtttgtttgcttgtttgtttgtttgtttgtttcactcttgtcacccaggctggagtgcaatggtgcgacccttggctcactgcaacctctgcctcccaggttcaagcgattttcctgcctcagcctcccaagtggctgggattacaggcacacgccaccacgcctggctaattttgtatttttagtagagacggggtttcaccatgttgaccaggctgatcccgaactcctgaactcaggtgatccacctgctttggcctccaaaatgctgggattacacaagtgagccactgcgcccagcctaaaaatcttttttacagtattttttaccttaccttttctttgtttaaacacacaaatagttgggtatagtaacttgctgtaaaggattgtagcctagaagcaatgggctataccatatagcttaagtgtataatagactatactatctaggtttgctatactccacgatgtttacacagtgacaaaatcacccaagaacacatttctccaaaggtatccctgtcatcaagtggtgcatgactatattattgcccatggtttaaagttatattggtggagagtgaattaacggcttactaacaggtcgagctatcatatttccgtaatttgtaacccattacataacttataatcaaaaataaataattaaagcagggctatgaaaaaatatcacatggcaaaataataagaatcatataacaataaaaagtaggttggagtgatgaaagatttctggttcataaaaattgacataactaagagttttttatggtgccccaggtgctatttatgatttgccttattttctctaaactcactatggagccctaagccctaaattagaaactatagaaagtgttttaaaggatactgcataattttaaaggagctattctgatcaagaggaagagcaggaaagaaataagctgcgaccatttgagaaaagaagacaacgtgcaatccggtgtgaattttcctagcattgaaaatgttctcctgaatgcttggagcagaataaaggaagatataacttcaccaagaggcaaggaaacaaacaaaatctttgcatcctatcaaatatgtgacaaagatgctgcagtatgcaaactgaatgaaacgtggtctggctcttgagggtggaggtgaatgagactacagatatgttttggttttccagcacagtaacttaaaataatgaacatttgaatatttgaagattttgggaaggccatgccacaggcctcactgctctatgttctcttacatggagcttcttcttatttttgtgacccctctaagccacttgaggttgggggtcctcttagaggttactacagaatgtgacagggtagaatgttagcgctggtaggtccagtgcaactgccccaattaaggctgatacaacagataccaagaggtaacaggatgtgttaacgactcccagtaagtaaatcaatagaaaccccgatggtgaaatttgggctgcccaggtacccaataaccttttattatttggtatatctacaagattttagttgtacattttaatcttatgttaaaactggtctagaaaaaacaattatcgtccagttatcaacaatgcattaattggcttcattaagggtccttgttgctggagaataccagaaatacccagttttataactttttgattgatatataccacaatatccaaatacacacacacacacacacacacacacacacgcacgcacgtgcatacacacaggcttttaatttacctccatcaagaattcacaaagaatctttaaggattctggaattttaagatagcattcagcgcaccattccttcaaaaacaagcaactctctgaaaatacatttctatcttaatattagctctagcattaatttagattgaaggataagataatatacacatactcaataattacagagttttcatggcttataaaaccaagagtcttgagaaatgtacttaatcttcgtaatctttctttctagatgaggattcttatcacaaatcagtgtatttggcacctatttggtatgctggaaagcttatcaatttagtatattctaggaactgaaaaatcagaagacaaatactgcatgatctcatttatatgtgaaatccaaagaagtcaaactcatagcagtagataatagagtggtgattaccaatggagggctggcaaaaggggagatgttgatcagttttagctagatggcaggaataagctttagcgatctattgcacagaatggtgactataattaataataatgcataatatgtaaatatatacaattattgccaattaaaaataaaataaaaataaaaaacagaaaattcataatctcagcaagtaatattgaacaaacataaaattaactttttcaaactgtaattactatattgcttgtgcagacacttttaagttgacggttcattatacatttttatatcatatttgagtcatatttaaagggaaaagcactgatgaagttaattttcaagaatatggtcaaaaaaagagaagagtaactcttgaaattactgtaaagaataaacacagtgaattacctcatattcctgggaaaacttcaagttgtcatttgctttcaatctttcaatgtggtctgcaagttccaagatgggtattggaggatggctagccatacctattgaaaaaagcaaagaagaaacacatttgaaaacaaatgaaaatgatgctaactattccaaaatatagagaatactatagttagaaatggcctgaaaatatgtgagtagtaaagatgttttaggtgaggaagcaggcaaatagtttggttactcaaagcaggacatgctctgggaagatgaattttgtagccaaatgaaaagtcaccaagcataatctccaaactaacactcctagtgtaaaagaaagcgttattgtgctatgaatcaataaggttagctagtggaaaaaactgacagtcaggcttgatgtcaacttctgctttgagtaatgacttttatgccatttcaaactccttctcctgcactgtgtgaaatggaaattgtgtggaattaaatggtgtaaagtgaaataagaaaacagacactgagaaaggcctaaaagggaaagagtagtagcttgatagtaaacataaaatgacttatgcataatcaaggaaaactaacttgaagaatgaaggttaccagggtaaccggaatcatctgaacctgcaaaggaaatgatggtgtaaataaaataaaatagaacaaattcttcaaaaaaaaatgaaatggaaagcctgatatattttttaaaaggactaattaaaatgctgcaagtttttacagaattcactatacattgtggctagtacaatgtgactactacattaagatcgctaatatttcacaaacctgtaggtgactgacattcacatgcaaacacagacacaaagaatgacatgcaccacgactcactgacgataatcactgacggcacaatcagacaccaaactgagcttcaaaaatgtttccactagtagcagattgtagaggttggggttgcagccttctcctggacatttataaatggccacactaacaactctgtgatattttgccccaggtccccattattcaacccccagcaaacctacaatctacttcaggtgtaaacatctttgtccactaatgagaaatggattcagggaagtgagcaaatggtgaaaagacaggagggaaagagggtgaagaaagaaggaaagcagagatggggtgacacattctagttcattcagccagcggaagatatagtaatttcatagattccatgaaaaataatccactattaattttggtgactcctgtgtctttctgatgttttctcacttttcatatgatttgtcttttatttctttcctattaattttacagaagtatcatgaaagagcattgctgactcttatcttacagatataaattccagctggctacaaaaacctgaactagcatgtccccagggaagccactgaagcaggaaaagaatgagggaggagctcaaactggaagccatgtgttgacattctgctgtcactgtggctctttggaggaaggctacagaatgatggccattgagtcaacatgacatgtgactactttaagagcattttaggaattataccattgttaaaagtcacccagtaagttcctttatctcaaatgccaaattattaatggttctggtaagttaagtaaaaagctaccctgctttttgaagacaaccactttagcaagtgttgtgaattgtggtggtttagtttttatggctatgaaggtctgcttccagtcagctaaaattttagtggagagccaataaaactgaattgcttgcaagtagaaactctttgttggtgatataataatgcctttggaacaaaattttggaaccctttctgaaacttttctgtattaatgatagaactgaaataatttacattctatggaggaagtgtgagggtgacagtgatctgataattacgtgatcttatccagatgaggcacccccaacgaaaagaatggaaatgcaaaggcataggtgactttaggcttatctggaaatggaaatggactgatgtggacatcattacagtgctttcacagagaaaataatagagacaaagatgtttagaccttttcgagcggatcgtgggagagagttattatcatatatggactgagtggtggtttggctagagagggaggacacagagccaatcagggaggcgtaggggactgaattactgctcaaagctgcaaaaagtaaagccagttggagacgggaaaagtattagtataacagcagtagaagaccataataataaccaaagatgtgatcaacatatttacttgtggcatgcactggcacatggtctggaagtattatattggaagtttattaaagaaaaattcaagcagacctacattgagtcattatattccacatcagaatatatatacatatatgtatcacatgcaagatatcacagcattaaagaatcgctacataaaacttatcattggataccatattgcactccatttctaagacaagtaaaaatggcagatggatgtttcacagaaaagggaggagaatctgtgtgaatccaatggtacaggagaaagaaccctggcttagaatactggacatgggttctacttctggttttggcatctactaatagggacaaatcaccttttgtgaagcgccttgatttctttaactgttaaaataagagtatagaactagataaattcaagagccattctcttcttcataactttcattcttcccacatatagacagaacttctgaacagagaagggtctattggtgcatatgtaagggttctaaaagttatcgtaccttttctttgaagggagagagtacttactttttacaaaatggaaaactagtatgcagttgaattgtttattttttgaactatttaagtttgttgctattttctttcattagccaaaatgtatacacagtctattatgatgttatatcatatatcagaaaagaccgaatgtcggcataaaaataatcatcaagagtaaaactcctctaagttgaaactgtttagctcatatcagaaaacaatgaccaaggatctacttcaaaatattgttacacaattctgcagaaacatctccgctgcccaatattgaaaaaaaatgttatatgatataaacaaatatgttagattttgaatgaaaaggtagacactaagaaaactatgaatttgacctcactgtggtaccttttcaatgttttgtctggcaacctgaccactgctcagtctataaaccaaagtctttactacatcagattttacacatttaaattacttgatgtgctttaatttttttttttttttttttttttttttttttgcaggctgtacaccagaccaattaattcaggtctgtggatgtgggagctatatattgatatttttaaagttcctcagcactggctcttagtcctataggattcatgatggggggcctataactccatttattcctttttttcccatttagaaatcatatcaggatttatgagaatgagatgagctttctcttggtgatattcttgaatcctctctaacaccccattagcaagctttagtactcagctattattggcagcaaagaacttgaagcacagctaacaaacagggagggcttgccagtgtcatgacctcatcagttagaagctacaaatgtacaatagaaatgtattattttttttttttttgagatgtagtctcactctgttgcccaggctggagtgcagtggtgcaatctcggctcactgtaagctctacctcccgggttcaagtggttcccctgcctcagcctcctgagcagcgggattacagggacgcgccaccacacccggctaatttttatatttttagtagagatggggtttcaccatgttggtcaggctggtctcaaactcctgacctcatgatccgcctgcctcgggctcccaaagtgctgggattacaggcgtgggccgctgcgcccgacccataaatgcattttaaaggcacgcatcaaatctgttaagactttttattttgaagctatgatctccacaatatagagtcaacatgaaaaatgacagatgcggtcactgaaatctgccttaggttggaggaaaaaacaagatggctccctttaatagggtacatattggtgagactgatgtcacggtgacttccttataagaagtaaactttaaaatcatggcattttaacctgagaggcaccttagagatgacttagtccagcactttcactttatacaagaggactcaaatccagaaaagttagatgacttctctacataagcccagacagtaaataacaacatctcaacatgcagcttgggcatctttctactgtactattccgagaacggcatttgcgatcttctaaatgaagtggggggcaaagtctccacagatggaatgggctaggctggtaagataaatgactgaagagggctaagtatcatatagtcaacattttcacacacagaaaatacgctcattcccatttcctcacaatgagcaggtttccagggctggcttttgtgtctctactttgaacagagactccagaaagaacagtaattctttactatgtgaaaaacagccataagcgtgacataaatggcaactaacgctcagtctcaatgtcactcatctttagggctagtgtacacattggggggcttctgaaaagggtgaaattattcagctccaggacttgctctgccaagtgggaatgcaaggccaatcggttcagactgttcaggttttcaacagccactcaaaatccagagtatcgtgtggcatttcctcagttttcaatgttgactcaaaattttgttgaaactcagtccatgtcaaacgataagctcttttgcagaccacatacggctaactagattatggcctttgttttaaaagaacaaaaccttctttaatctgtgtgtatgtgaattagaatcaaggagtgttgggagtgacagactgcatgcttgtatccacaaggcaatggactagatactgctttgtgctggggatataaagaagtatgcttcttgcatggttcatcccctatgggttcatctacctccccttctctctaacctgatcccccattatctctaccaattagaaaaatgaagcccagaggagttaaagaactcgatcaaagtcatcattatcagcagaactgtagctacatgaggaatctgatcccataccccgtacactctcatttagcacatttcacatgacgccatgctgtctttccaaccatttaacacccctggacaagtggtgacatgtacataaagctgggtctttaagactgtttgggctctctatgcagcaagacagagatcataaaccatcctcagtttgtgaaaaagtgtcaatacagggccttaacctaggtcatctgtttcagtggtggggaagaggaaaaggggatgcaaaaacacgtctgtattttccagttatttcttgccaaaatatcctaagtttccaagaaaacatgaactaaaggtattaatttaaaatgttaaaaactggaatgctatttggcagaatatttcttagaagctaatttatggtatttttgcttttcaaaagtcctgctctgttttactaagtcagtaaggctactgaatgcttcaaatgattttattatccatagaaaaatatttatcaaacacttgctctattttcatatttttaaaccttgcattaaatgccaataggcactatataactattctgctaagtagagtttttgaagtcattaataacggtggtacatcttttacatgatttttttctgtcactatatacgtgtgtttgtaatgactcagtaacagtctcttcatgattttccttactgataaattgtgataaaggctggagaacagtttgtgcttatggaccaaagagaagctaattttttcatcaaatcaattaccacagtcttaacaaaagtagacttctatgagttaacagccagaaagagaaaattcattcattaaatatttgtcatatttttgacataatgtatgcactatttagaattccctgaatcaaatacaaatactctgctatatttgttatttgtatcacaaactaatgataaattaaagataaagagaatattgatttgtaagcttcctgatacaaccataatgacaattagatttaatttgtgactggggatcatcattaaatgaaagagtcaccaacagtgcttttctgggtaagcaatgaatggcataattaaaattcaaaatttttacttcattccaggagtttctgtccagcctgggcaacagaggaagaccccgtttctgcaacaaaaatttttttaaatgaaccgggcattgtggcacatgcctgtggtcccagctacttgggaggttgaggtgggtggattacttaagcgtggaatgttgaggctacagtaagctatgattgtgccactgcactcgagcctggacaacagagcaagatcctgcctcaaaacattttaaaaaatttttgtaaaattcaattctaatggagagtttctcaaaatacagaatttgaacaagctgtttctttatatcagaaatttcagaaaataaaacagaaaggacacatccggtattcttaacctaggtcatatgcctaaattccttactgtataaaataaaatatgaatgtatgaagaaagtatatataaaaatggatcttgttagcattgatccaattaatagtattaatagatcagaagagacagctcaagagctttttaaagcttattcagttgctgtgcagacatttctgctgctgataccactatttctgatccgttaactttttatgagtttgtttctgttttcacagcccatcaatcacctaccatccatgtatgctttagggcaaaacatattaaggtcatccactgaatgaaaatgaggtctttgtgttgtaacatctgatcatcgagttttaaatctcttttcctaaaaggtgcaagcataaacactatagttttggttttgtttgcaggtatttttgggccagggaggaggtatgaacagggacagcagacactttaatattgaatatgcaggcagaggggaaggtaatgattggtgcaccaccaatgctaccagtagcatcttctcttacaactttctttgtactgaaaagaaagtgaatttctctaagatcctcaacctctaaattttctttgctgggaaaaagaagaaaaatgaacacatattagtaatttgtttggttttcttatatatcaccatcttttaataatattatgtttattttcatcattttgcccaattctaaaggccatgggccagagggtgtcaaaccttcagtaaaggatttttacagtattttgaaaagtctgtaattgggtctctctatcaaaatggtaaatgtgcctaccctaggaccctgctatcatatttccaggtgtctgacatgcagaaatagcaatgatggtgtcaaaatatatgggctcagtaatgctcattacagtagtatctgtaatagcaaaacatgagtaataacctagcctccattaatagggaatgagttaatacattttgatatctatagaactgactaccatcattgtcattatctgttaaaaagaagacataatacactcacttgaaaaaagtccatttttatatagttaaatgtcacaacagcaaattgtgtgtgtatacatacatgacatacacacagacatccctacctactctatattatatcatttaaataactacatacacaaattaattctggaaaggtatatatgaaactctatatggcagatatttctggagacttaattggagtaatgacacaaaatattttaattttaattttaaatatgtcaaataaaaaagaaaaaaaagtggtggaatgaagagtaatttttcttctctaaaagtgcttttgttggaccgtttcccaccatataattataaaaattttcaaacgtacacaaaattaaagagtaacataatgaacacctaaatggtcacaatctatatgcaatgattgttaacaagcttattttctattttccaaaatttccccaataaacatgttgcttttgaaattaaaaagatgttctgggacggagagactaaagtaatttggaaattgtttataaaagaaagaaagagaaaactttccttgcaaatggggctaacacagttcatctttgtttaacaagcaacatatctattcacccatcctagtgcgcacccagttactgctgtctacagagatgtatggagcttaatggacatttcctttaaatgcatcttttataagtgaatattttcttcccttcttccatagatcttaaagacttgtaaaacttgatcagcagttaataattccagtaaactcctctactacgtcacctctctcttttacttattttgcccatcttattccactatctgttagaattaataagtcaaatcttagctaaatgataccttcctatatacttaagtccccattttaacttggtagttattggtgatacaactgatgttacttaaattgcctttttcacactaattctggctgaccttgtacactaataatgatttattgtttaaatcattattctcttaaatgattaggtagctcatgttgtctcaaatataacttggctatacactgccatctgaaccacaataagacagacacttacaatcaatcatgcaaaatacttacaagctgaggtgcctgctttcaattgtgaaagcatgggcttccccgacctgttcaggtgtttacatacagtgtttcacagactgacaggatattttttttcattttaaagtatactttaataatgaaagtgtacaagcacaaaaaatgataaatgttcccgtatatttgtccagacttaccatgtgaacacatcacttaagtaatagattggtcctaacactatgcagcatcctgggatcctatcagactgtttatcctgaatctagtcctattcctagaaaaactaccatttagggggagaaaaaaaatttattcaacaattccatattgtctctgatgcagcaatcggttaagtcacaattacattatgctcaataagagaaaaataaaatagtttttcagaaggggctgggttggtgattcttttttcactcatcttaatgctaaaaaagaccaagaactttgttgccactaacgaactagtgggcttcagccctgaagtacctctagctgccagcaccatcagtgacttcagaatgagaagatacagcaactccttaaggtgctctgtacagattcaagtccaagctacttctttggaaggctctcagcagtgtcagagagtgacttgattcttgtctaaaagtttgaaaatgtgctaaagcaatgttcctctccacactctccaacctcacaaggatggttatactgacaaaaaagcaggtttctctgtcttttctttgtgccttagctgagcaacggtggatggaaatctaactttttctgatccaactatgtttgtggtactgcatttaagggtacagttctttgacgtacttagattgttggaatgctatatttatatgaaatggggaatatcgggcagaattaaggaaaaaagatctgacttcttaaatctcgattctccaaaagaataaataacttagaatgtaaatcaatctttcattcacaagatgacttttttgagaaagtagaatttatagaatcactgaactaagcaatgtgctttctttaccttctgaaaggcctactgaatttcaaatcgtaatgtttgtttgctattttatcattcataacagacccatcagaagcagaaatcaatttgcctttgggaacaaattctgtactaggtactggttatataaatcacaggcatcttatttcattgaaagacattttttgaacagaaggtgtggattactaattctctacttatgtatattattaataaatattctcaagcgttataatgtttggggataagcaattatacattcatagtagatatattaaaaagccacatttcagagagtgaaatgtaaataatttaaaaacctaaaaattagcgtcatagcacctgtcatgcaacacctaatgaaggattattttatttcattatccaagaaaacccttgattcttcgtgaaaaagaggagaagaacaaccacaaaagggttactgggttaacaaccccacattctgctctcatcctattggcaagtaattatggtaattaacagccgctggctaaaatctatgcaggctgaagcaaatggtcacatctctatgaatttcatattaacagcggagtctatttcctttgtaaaatggtaaaaatgttccagacagcaggccacaacatagagcttggatggcaaataaacaatttcagcaaatcaagcttaagtgaattgcttacctgagctaaagggcataatgtactgcttcctgagtgaacagatgtgctaggaccttaggacaatttctccttttctagtctcctcctctactacagctcctctcttatctcattttgtctactacagctcctctcttatctcattttgtctactttattcccttattcatttgaggtgataagtctaactttagttaaatgacaccttcctttatactcaggtccccattttaattttgtaaagtcattggtgatacaagagatgttacaattgtaacattcattcttctttctggtatcttacctaaaatttaacagattctctctataaatggatataatattcccaaatacattgggaaaattaaattgctaatagaattcttgagtttggccatatttgcaaaattacatctgaaagtgagaagtacttgcagacagaagtctcctggttgaagacattcctattctcttacctgcagtcaccagcacctcttaatcattctctctacacagttcccattcttgctttgtgtttattcccggaaacattttctgttggtgcgagaggaggtgaggtgtagcagcactctcactggctcccttcttttgggggtacccttgcctttctgctcaaccttatactgtgtttctgcctccggtggaagaccaaggttggttccagcacaaatgacatttatgtgaaaaacagaggaaggaggggcagtggagagctagcagcaaggtactgagaaatctgatccgtttttctatttccacaacatgttgctcttttacagggtgatgaggtaagaaatgcaaggaatcatgtagcagatcatttcttcagcttttgggtcctctatacattgagtttgctaaattgaaaggaatataaattcctgggtccattattaagaagttgcctgtaggccaggagtggtggctaatgcctgtaatcccagccctttgggaggctgaggcaggtgagttgctggagcccaggagttggagcccagcttgtgcaacacggccaaactccacctccacaaaaataaaaaaaaaaattgtctggatgtggtggcgtgccccagtagtcccagctacttgggaagctgaggtagggggatcacctgatcccgggaggttgaggctgcagtgagccgtcattgtgctactgcactccagcctggacaatcgagtgagactctgtctcaaaaaacccatcaatcaaacaaacaaccaaaaacaaaaagaagttgcctataggctgaagtagttagtatccacctatttcaaaaagcgctgacccaatgaaatttactacagtaacttaattcatatcaagttgccttaataaagtactgagtaggtgactcaacaagatgcatccagagggctacgacctatcctggaagatgacacaagtttgttcaatcatcatgtacacgttcccggtgcatgatgaaataattttttttaaagtctaacctcatatgagttagaattttttttaaataccgacattatgatgcttgtatagccacactgaaaatgctaaacatttctttcaattgaagagttactagttactatgttacatctacatgtaaaagagaaaatatgctgaacataataaaccatgttcaaaataattcactgtaaaatgtgtactgtaatatatctgcagtgtatcatactgtgaatcagaacatccatatggcacaaagaaacttgtctacaatttgtgggacaacactgcaaccacattttaatcccaaagacttcttagattagcttttcactttgttcattatcataacatattaagatagggtcactcggttttatattttcagctccctctgccattcataatttgccattcatttggtataaacatgctttagttgaaaaagtcaaatagatctaggcatgaataaacaatattgtgcagaaggcccctcagtaggaatagtagtgttcctctgttgaagcacttaatgttctttattttaagaaacaagtatattttttgttatcctcagtcactttatgtttctctctagtaagaagcctgaagtgatcagtgaaatttagtataggtaatatttaaaaatatttacctcattttcctccctccctccctccctttcttccttcctctttcagagtaccataaacacaaacaaaaaggaaaatatagaacaaatctatgctttcccatgggatgaaagatgtgtacagtcatccatttactcattcattcacttgatgagaaactgaattctttccagagtggtgtcattggaaataataaaaacaataatcaaagcccataaaaatggtagatattattataaagactatagttcttccaaaatttgaaggatacccatatttctttttcttccctacccaatttccggtttgcagaaagaacttaatttcctttcagacttttgcttgggcaagtctccataatagtaaaataaaagagcaggatgaacaaaatggctcaaaataaagtgataccttcaactcttaatatcaattgagctgtacaacttctgggaaagactgtgtgtggattagatgtgtgatgcttcttacccggtgtttgaaagttaaggcgcctcagttctacagggtctgttgggtggtgtgaagggatctccttattgttcggtatgctgctttttctagagtcggactctgccctcttcctatagggggaaaatagaaatttaagaagaaaagaaaaatcaattgaaacagatagaaaagcagagaattgcacctgcactccccccacctcccaagttttcagttttacaacttttcaacccagctgacttgtgacccagttcgggttgcttttcccccctggcctaattgttctctcaggtctaaaatttttgtttaagtcaatgatctcgaagtcctcctccaactgcaggattaaataattcagcaactctgccttttggtttcaaagggatcttggtgagatacgcatggacccttattgagcaattctctcttatctactagttctatttgtgaggaacaggataggatacccctaagttgccaatactaagactgttgttaccatagagaaactacctgaccttaagctgaacagctaaatctgtcccccttagccctaagtatatataagtggtgactacagagagtagatgccgtagattttcccataaggcaggtaaacacaagtgcatttttaagatgccaagttatcctaatgcctaggataatcgggaccaggtaaaacagaactcccctttctctttcaaatgtgaaggaaaaaaaacagtgttagctcttaacagtgttaagctaactgtgattaatattttgttaatgaaaggttcacagaaagatcagagaaaaagtaatttcacctggtgggtagatcagcgctcctgataatcattcaaggtgccattgacagtgccttgttataaatgtgattcttcacacaatacattttaactttgttctaaaagctatctactagctttattagatatccccatttaagctctcattatgtaattttaacaaatttctaagcaagaaatgtcagatctgtatataagatttctttatccaataaaaaattaatcacagagtcctaactatcttcttccagtttgaattagattaaaaacccattgaatcaatagaagccattttcaaacagtgctttttttccaaatactaacgcctgcaatctctacaccacagtcacaatcctagtatctcacccctgctcaaagcaaaggcgtttttactgtgggggggaaaaggtgctgcacagtgtttaggaactttccttttctctgttcgatgtgactgtggtacagctcattagtgttgctgtggcaatggggtctcattcaatgccacccaggtcgttctatggttagccagagggctcctgttaaatagcctttcttcccatttctgctcatctgtataaaataaaactaaccagggggtgaagagaagattgatacaaaggggacgtgcacatgatttgctcaagtgcagtgcctttggcaaaacatccttaatggaatacattttcatggctaagtcctattagacatgttgctttctcggtaccttagattaacctgtctgaggatttcttctttctacctaaaggtgtcagatacagccttgggacaaaatgtgctgccaacccattccaccaatcagaggtgagcagtattctgcgacctgccaaggtactggcagctccagttctatggagtagaaaggaagaagaaaagaaaaagaaaagacaaagggctggtgaaaaagatatgaggacgaagaaaaagacaggctcataagaccatgcgaaaggaggacatgatggccagtttcagagtaggcaatgtcactgtgtctgtgctatgggtcttcgcctcaccacactaagagattccttttaccactgaagatgcaaaatcgaaatgggttaatgaaacgtcactgggtgcagccagccagtcaattccacgtgaaacatatggttggtcttctcacttcaaataataccaatggcccttctcatgttttgatcattttgcataagttggcaaggatgcatttctttactaatgtgtcaggcccaacgactaaaatttggatttttctcccttcccattgtggctctgccattcttgcaagattatggaaaccagaattagaaatatctatctgggcaagaaaactactttactcttacaggtattgtagggtaacctccttatcttctttttccctgtggctggggtgagtgacactgagctggagggtagaaaagaaaactctctaaagtaatttagcccatttctctggtgcaaggaaagttaggaattacatcttgttgcaaagatgtgagtctcagaaaactcaagacatgggactaaaattacaattcacaatttgaatgaacagggagggatgtagtgacatttaataactaacttctctttcactgtttattcaaatgaaattatttccaagacctcagactcctgaaatcctagtcaaatagaaaaccagctgcttaaatgtattttgcttagttttctttcgatgatcacaacatggataattctggctgtccacattcttatcacattatttttaaacacttattatgtgatgtgctagaatgattgttttctaacacagaaaccatttctaggaaagatgtggaagatgaagagtttggtcatcattggtaataatactaaagagttttaaaacgttgtcataaaatattaaaagacatataatggtctaaattaggcccaacatgaatgtaactagtaaccttttttcctgataaatttcagaggtctcatcattctcattttcgatttgaaaaatggaaagaataatgaatagaaacagattttaaattttgccttgctctattttttttctattaagattataaaatgttagtgcgagtttatttcttgcagtgagaactatctactatgtggaggagttatgtaggtgaaaaggaaatggaagatcacttgacattttggatctgtcagaaactgctaatactataaaagcatgtggttgtttgggatgtgggtaatacacaatacaaatgctactctggtctacggggtattttgctttcaccaggctctcatctggggggaagaaaaaaacaaagagaagttgagtgaaagatcaattcatggtcttgaaacaaagatatacagacatgtgagaagaggcttttgaaagaaacatatacttattagaaatatctaccatcaatattcaagtaaatcaatcaaaatatttgtttctgttaacattaagaatgtaatcccaactctgccactactggtatgtgtcaactacaaattttcttttcagtttatttgtgtataaaatagagggagattagaagaggatgtctaagttttggttcaactctctcattttaatagaaaaagaaagcattaagttgtaaaatatgaaaagtgttatgatgaaaggtacggagtcccactctgtcgcccaggctggagtgcagtggtgcgatctcggctcactgcaagctctgcctcccgggttcatgccattctcctgcctcagcctcccgagtagctgggattacaggcgcccgccaccatgcctggctaattttttgtattttttagtagagatgtggtttcgccgtgttagtcaggatggtctcgatctcctgaccttgtgatccacccgcctcagcctcccagagtgctgggattacaggcgtgagccaccatgcctggccgatgaaaggtagtattttaagtgagtttaaagtgttttgtcttttggctgaaaaaacaaaaacaaactattttgcacgtgtttttctgctggacaaatggatactagagatgtccacacaaagaagacaccctcatagaggtttaaagattcttatcattgaacatgaggcttgctgaccaacataaagtgattttagtgtaaataatgcagcaatagttctcaaactttagtatgcatcagcatcacctgggaaggcttgttaaaatacagcctggtgggccaatgcctagactttctgatttagtaggtctgaggcggggtccaagggtgtgtatttccgtcaagttccctggtggtgctgacgctatggctgctggtccagaggccactcaatggaaaccactggaatatggcattgggagaaaggtaggtgatcttcaagatgttttttgtagtttaattttaatcgggaatttatatatatgttacatgtgtatatttatacataagtgtatatgaatatatagatatgagttagaaagctagagggttagtttggattaatcattcaataatcacatagtgtattttagctattattattgctcttattattcaagactgggagacatggataataattttgaattggggaagagttctcactaaggcactgtcatcaatatttgcaggatgtgaaaatgctaatatcattaggtgatctgtactcaaacttgaaaactaatctttggtaaaaacaaacaaaacaaaacaaaacagtttatgagacacctcacatgtctgctctgtaaacacatcaacacacacaaatgcccattttaatcttgaccacaaacaaaactcagatattggtttgtgtactatcttttaaacttcgcctttaatctgtttttttctaatgtaaacaaaatatttattttccccagaatcatcttaatgaagttactgtgtatatgtaggctttgcccatcttccacgtgccaggtattatcttttgtgtgcagccccgccctcccctcttcaacaactctgaagtctaccagtttatttttttcttactgaacattaaaggggtttgttctctattcctcacctgtcgggtttactgctccattttaatgcagcaaaaaaaggaaaaagaaaggctaaatgttagttggccaatggtaacaaggataaccatgacaaccaagatttaagaaatagtgttcacaagcaaggacacataactgacatacattcagaagcgacagcgaatcaaaatatttatagacctctgattatgaactaaacagaggacatgaagttacatcactgaatacatagtgtgtgtgtgtgtgtgtgtgtgtgtgtgtgtgtgtgaatgccacgtgcacttttatccatcacctataaaatactgccacaattaattatatcccaggaagtgttcgacagtggagagataatttgatttttaaaaaacatgctatgagaaaactaatgtactcaatgggaatacagcatcattccataaaagaaattcgttcatttaaaataaaaagccttcaattaagaggtatgtcattcctttcatgatataaaatatctgcaaattgtattgaactatacagaaatttgcacaattgaataatacaccaaaaggtaataaggtggcagaaatgatttcttcaaacacctcttgccacatcttttttcccatgaaggattaagtgcatcttcagtttaggaaaatataatacccatcattataaatctacagagcatggcccatttatacagttgggctaatccagaaaaacattttattaccagccattgacagaacatgtattttcctagtctgtggtgctgtctgtgaacacaactagttcatgcttatagatcctttcacctgtgataatatgttgattgtgtaaataaccatattatttctgcagagtataaccttttcctgaaaacaattaatctaaaaatcttcactttgaggcaaattgcaaagttttcagtgagttcccagttgcaaaataaaggtactaagtttttcttaatgccaatgaaatatatacccaagtggctggaatatctggccctgtgagataattcaatccatctcttttcaaaaataaaaaaatccacatttaaatggtacaaacacacacatacaaagtaaatgatgaaaatgatatcaaacacattggttaattcttcttattcttaattttatagtgatttacgtagtgtgccaggttaaaaagaattctatataaatgtttccaatttgctcactttttaaaatcagtgactttatcagggaatcagttgtagaaaaatctatgcctcaggatggaaaaccatctagtgaattatcagttctatgtattaaaaggctgttttgagtattcatatgcacaaattcatagttccagataaaggtcagcctcaccatacacctgggtacatatgtggtacaaatatctaagtttgaaagctttcacaactggtaaatttaaattataggccgaggattttattgcaactcttgccagccaaaataaagttgatattgagtgatggagtcaacatgtagaaggaattgagtttgtttaatactgtttgacttgtatacatttaattattcaatatttttgtgtgccaggcactctactaggcagtagcaacacaataatgaataagacagagtccttgacctgcagtttagtggaggcaaagtgccaagaaaaggggcattgacagtaacgcagtaggttctacaacagacaagtagaaagtactttaagagctcaggaaaagtgatcctaaagcagcccgaactgctagagaggggaggagaagagaggacagaaaatgaggcaggcacccagaaaggcttgatttagtaggtagcatcctagcttacttccaaaggatgagttggagttatccaagccaaaaggagtggcaggggagtgacaggaaaggcattcctaacctagggagggcctactcagaagccagaaagcagagtcaaccagcagcttccagtatggttgggtgtggccacatatttcttcatagcatctcaaaatattctggactgcatttccttgatgagggcttggaactgtatggagggttgatacagaaagagaagactaaagacacaaagcttgcagagagccagtgttggagcaggaaaaggctggaaaaactgaagcctacatttcagtctcatctagctcatggtttccacatcctgggatggggatggaaaaatagtgtgcatgcaggctagattattaccattcaaggatgttaattttgcctgaagtgcatctcagacttctaggaccacctgatctacactttctttgattccatagtatgtaataaacactttttatccatcttgaaatgcttttccatagaggtaaggttaacagtttatttttaaatgtttattttttatataaataattcttggacagttctggaataaagtctgaaaagccttacatatgtaacagatatacagaataagaactttcaattgccttgtgaattttttgttggagtagatggacgtgcagtaccaatactattatctggtgtttaatgttttcagattatagcgcattatgattaaaaaggtctaattatctggtccacccactaactttgtaatgaagaaatgtaggctcagagtgttggcatgaatttctaccccatgcaaccagctagtcacagaactgggacttggattcgggtttcttggctcctcagtccagtacttggccgaacgttgctactatcttatctctggaatgtgtattttaagtcatgggccatataatattttttcaaaattatagtacaagaaaatttataacattaaagatataccaaatatattttaattttctgatgattcagagggtattttagggatcttaccaagccctggtgatttttttttgttactgattatcaatgtattataggtatacagattactagattaaaaacaaaagttaaatgaacagaatgccagatcaaagagtatgccatttccacatgaatagatctaataggaataagtctcaaagtctcctcagacagctgggtaaaatatacttctttatatgataaaactatctgtagctacagacctattgctaatgctagcatcttagaagcagagatatatgataaagtggattatcaatataatgtgagtcaacaacgttttattctcattctcttctcaaagcagtatttgcatatgggaagtaaaatattctgacaataataataataataatactttcaattctgagtcattaccaatgacctgtatataaactgaaaggcacctaaaaagagggaatggactatttattatgtaattaactttgctcagaatccaagctataaaagacactattcattgggtacagaagatttccttttgaactgcctcatgataatcaagaaggacattgttggttctacttgaatttcaagtcaggaatgttctttactgctgaagcaagcatttctatttcagaaatgcttcatgggccttcagatggttagctaaatatacttagcattcgaggatgtgtgcatttcccaacaattgcattagacgatgcttacataggcccacactaaaatgctactctattttaacagagtcataaaacctttaaatatgatacttctttttgtgggattaggaaaaattataagtgagttgattttttaagcacttgcagatgaaggaagaaaatagttatcttttaaaaattattagggctataatcatatttcttcaaatttacatgactgattcacaaataccatatacatctgttgcttggtatgatttaatgatagctatgtatatccaaataaaacataacttaaaaataaggcattaatttttcccatttcaaataatcacaaaatgtcatgtcatatggtctagaaatacacctgtcaacaatcccttgttttttgacctactcccatagtagtatgtgactacctaaatcaatatttcccagaaaacaattagaattataccactgctttttattattgaattctcttctggaaaaaagtgcagcgtacagacagcaaaggacaccagctcctgcttggactcaaacagggtctatgattactcacggggcaggtgtgtacctcatgcttcctgcccttatctcttacatggagagaggtaataaaatacaatgggttccttaagatacatgcttatagatacagattggaatggaagattcaaatcatcaaatgagaggagattttggctttccacacttactttttcagctattttacagcacggataattgaatgatggcagtgttcatgaaaaaaaataatgatggatatatctttcattctttataactctaaaataggataggcaatttaatgggttatggttatgaacttctttcatttgtcctttattttctcaaccctctcttaatgctggaataaaatgaaatggagccttttaaaaacaagtttttcaaaagagaagagttttgaaggagtttctttttttaagagtcaagataagaggttatgggggaaaaacgttattccagggacagaagagcaagggagtgagggtgaaaataattaatataaaccccccaaaagggagctagatgggtaggaaaaagagtgaatggaaatgagattattagattaagcatgtaagcaagaatcaaaatgaagatactctttttagattctgaaggccaaggttagggacagggagagaagctatcttgtagtagaaggatgagatcaacttcacagtagcatttcaaaatataacacaccacaaggaaaacgagaacatggattaaagttttgtgaaaatacaatttggattggaaaaaaataaaaatctatataaagggaagtaattttgaatttagtcattttaaatgtttaagaaagtatattatatgctactctttataagttcatatttatattataattatattcttaagacagaaagaatttataagaacaattactaatgtcctctatctaactgactggccagtgccctaggggaaaaaatcttattagagattagatgttagaggcagaaataaaattgaaaaagagtggcatatcagaaaaatgtgggtagacacagattatttgcatcctaactgtagtcaaagacactactcaaatcaacacatgggcataataagactgagattatattttttaaaaaaggaaaatagtaccttggcatccctttttggacacatacacgaattcaccagtgcagatgtggaataagagttagaagaaaattgggagacgattcattctccatccttctcttttttttccccttccttaatccttaatttttatctgcttttgctaaattttgagaaatagctacagggagctatctcaacacttgcgcaaattagaattatgatatgtatacaaattgcaaaatcgtgatagtgtttcaaaaaacacactgaaatcgagcaattaattatctaaaacaatcaaatgaaagcttgcatggaattatttgcttgtgaatgcactaatgcctcaattgttatgaaaagtgcttatctgcataaagcagctcagaagattggaggccagaatagatgcatgttggacaacagaagtctataccaaaactgaataagattccaaatagtacagtctttacattttgatcttactgtaatgtaaacacttttccaaaaataattgaaatggcactgaagtatttctactaaaatcaaccacctaaggacagcagaacaatgatcaagtcttcaaaaataaggcagcctccaaaattacaacagaaatattgggcaaacctaccttttataaagaagaatagcaatgacaatgcagatgataaagaccactgcaaggacaggacctacaacccagatcaagccttcttcttcatccgtgattggctgcggatccagatccattgacaccacggggtcggagtaagggctggttgcatacatcttctgaggaaaagcagagtctatttcagttataaaataatgactttctagataagtacctttaacattagaagaagcaaaaaatccaggaaatagtggatttaatgataagtgtgtgatgcaatattagcaaaacagaggggaggggagaggagaataaagaaaagaaaggatggaagatgttttgtaatacaaatttccttatagagtgaactattttataataaaatcattttgatagtacaaattacttcatagacactttttattgggctttctatatggtgtattaaatgatcctatgaagcgtaaagtaccagtaattaaccagttgcaaaatgtttaatgaacatttacattgtgccaaggcgttaggtgctgtgtgaaaatcaagagaaaaactagagttctagccctcaagccattatcatacagttaaggagaccaaagtacatatttacaatgcaaaataagtcagtatttaattaaatgtgaatatcggtagtcattagtactactgtgcttcttagtgcttggtactacttaatactactgcatattagttaggaaatggaggccaaagcatgaacaaataaagtctacaatttcaaaagagaattccacagttcaaattacagatgcgagatgtacagaattgatgatatggctttataaaatatagaatttttagaacttaaaagaattcagcagttctcacttagttttattacagttattgctcagagattggtatgtttgttctcaatagacaactgataatatactttttaagaatacagttacttggagaagaaatggactaaatatcgatgatttttatttctatgatatccgatcccatttagttctgtcctattttagcctatattaggaaaacatcttcttggctctacctgcccccttcaaggccctatcttccactttccaatccaacagaaactaatccatatccactaactgccctgcttctaccactcactcctcatctcttctcactccaaaccaccattggtcctatttttttttttttcatttgccaaatctaattgcctttatttactctttacctttctagacaatttttccagatttgccttctttaaaacttttatctctggctctctcaattttgaattaaaccagtcccatcctcatctttccaactgctcatgccctgctgagttaattatctctgactccatcctatagacaaacattctttttttaaaaaaattttttttatagagatggggtctcaccatgtttcccaggctggtctcgaactcctggtctcaaacaatcctccagccttggcctcccaaagttctgagattataggtatgagccactgtggctggccctgaacccgtattcttaagttctattctctactagcatctcttgtcctctcttatctggcaaggtcagcccaagctttaactatcaacctccatgcagaatctgtctcttcattaatgttcctaaactcagatactctatgaaatcccagatcttcatttccaatcatttctagagacccctacatatatgttcaaattagtatgagtttcttaatttttcccagatccttcttcccttcctcctcacttcccaaattctctcatcctctcagtatctaagaatggatactgattttaccttacagaaaaaaggaatagaatggaaacactgatattagctaatcagtgtcccccaggtccatctgctcttcttctagtctcatgagtgccacttttctttaggcccttacttatgtgctcctaactataccaagagcttcttccttcctctcatagtctccactgctgctagaggtatcatcctaaactgcaactataaagccttcaagaggctctctcttgattcccaaataaaacgtagataacttagcatggttctcaagggcatccacaattttactttaaacttgcttacgacacacaacacattccatcacagtgggcttcttgctactactccctaaaggctctattcttgttcctcaactccctcacaagttccacaacatttagctcctgaaattgaacaactctccaggcccccacttgaatactgcctccaatgaaaccacctctttttaattgactggcagtgatcggtcattcccctctactaaaaaaaccaaaaaagataaaaataacacagctaaatttttatttagtccttgtttttttaaatggtactcaccaaactgtattttggctttttatttgtatatatacttcattttctttggcgaaactacagactcctagaaggtagggatttatatattatttgtgtttatatgcttaaagcagctagcaatgaaccttgtacttagtgggttctcagcaaatcttggctgaataagacaaaaaatgttcatcttttcaaatggctgaaattgtcaagacatcagtatatatgctcacttttcatgattggtacatatatttaaatgttttaacctgcatctttaaaaaatttagtttatggcatctattctgaatttaagtacaatgagcttggccatcaagcaggagaacagatgttccactgaatgcttgtatactactcttctctctcattttcgtcattgtgcccaggaaagagactgactagatttgcagattttctaacgcattacaagaagataaaaactcagtatatatgtccaagcttctcagaggcagccaaaaaaaaaaaaaaaaaaaaaaaaaagatgtgtatggtatgaggattgacacaaaggacttggcaaagaactatatatctaagaaacatgattttttatataattgttttggtttatgctttacccactccattttgtaggtgatgttaaaacagtttcatagacagaactaggcaatactgtctcatttgaaattctttaccaagaacctttaagataataatcacggtccattgagatggaagtctaagcacaggttttcccaaagaacatagatttccaacccattcaagaaacagagacatatgaaaatgaaaagaaaacaaaatcataaaatgataccagcctaatgaaaaatataatttcttgtgcgtggcaataagagattaaattttggataattccaaaccagttatctgacattcttaatatgagacaaaggattaggggatagcttgtgtctttgagagggacggagaagtattttctctttgcaaattaccagtctacccttggaacattgttataaactgatatggaaatttgaggcttacacaaaggctttattactgcaaaatgactctagctggatacaagtctctcctaggcctgcaaatatttatgatatataaagaaaataaatatcatagatatttgaaagcaatgctgagaaagatgatagaataaaggggcaacttcattaacaaatttggaaaaaattcttgattctgtaattaataaacagatgacatactaaagaaaggggcagactctttatcagttgtgacacatttaaaacactagcggaagacatcagaaaccacagtgtgtagttcagtggttcagtctgcaggatcgaatgagatttctcttctttgctagattctctgatctacctcaatgctctaagtatgctttttgaaatgttcctagagctattaaaagaaatttcctctcaaatatttaaaagtcatttttgaataaaagaaaaagatgatttcttaacattccattcccttgatgttctgccttaaaaccttcaactagaaagagaaagcatatctgaacattaaaattccaggaaggccattactttgttttcaaatgacattctgagcacaaaggtaaaccaggcagagaggctgcctttgtgttttgattttccacgggggaattctttcagtcacttgaagagaggccccactgtacacactaacacctgatgtggagaaatctttgatacattgtgagctgcttctatatgggaaatgactggctcaactgggttgccacacctgtcatatttagacaccgattagaaaacgaagtttataatatgtatattaaatgttcatgtgtactgccacttcaaaattcaccccctgcctatctacaatatctctcccctttttttttttaaacattcaaagtaactgaagcataaaatgacatataagcaagatggattacataaaagaagaaaactcattatttagaataccttaggaattctctcttttattaaattattttctaactttcttggcttttcactgatacagtcactcataaatttctacaattaaagaggctgctgtatttgcctctttctagatagaccttcctcatgaatccgggtagaggcactgtggtctcacttggcagatataggagaataaatacaatcacccccaaagtcagtattttcagaaatatgccatgttgaatggccaagcttgtgagttcccattgcaatcacaggggctaatgtcaaccaggtattatgcaacagtctccttttttggacaacagtcattttgaaaggatgatggaaggagattgtaagcaatgatggttctaacaccatgatatttgtgttacatcagaaggtatcaagaaccatgtcctatcgatctggaacttcataaactagagggccacctaaatttccttcatcagagacatagtctcatttgtaatgcagtctcaaggagtatattgagcaatgttcaaagagtaggcagcctgttattacacttaataacagttcatgagaaataatgaggatggatatacccacaaatccccaaataaccacattccagtgaaaatgtataagcgtaccataggaaacagatgccatcataattaacttacagactctgcatgttccattactgctaacacaaagaagacatattcttgaccactttggagttgcttgtttgtaaatccaccataatgcttgtcatcccccagggtgaactcagtgggaaggacatcaaagtgagcggcaatatatggctttaattcaacttctctcccataacggatgcttctgcgcttcctagatatctccttaagcagcttaaggaaaaaagtgggaaacagaaaaagaactgtaaataataacccagcttattgataatttaatgagataaattaattcagaactgggaacaacccaaatgcaatttgttcacatttcatatagcacatcagcatcactaaatctcagttctctcaatatttcaaatgcttctcttcctgttaaggtagaggtaagatactggactgctctgacaaggtctaggctataaacacagggcaatgaggtcctttgctgtagctcatttcatttcctacactaatgaaattctctcaaagtgcatcataacttgtctaaggaaaaaagtcagcttgattcataaaagccttgccctgcaggagatttattaaataagtattaacctcagacaaagccatctaaatctttaaatatagccacattttagaagaggttagtgccactttagattgttttgagtaatgagataactcatatgatacaaattccctcaaatcagcagaagcagaatccaataaacaatttttaatatacacatattaaatagacattgttactcatttaccaatttctgacttgacttagctccctggttaggcaattagggtgcacttccttacactttatcatggagtcaactttttctagaattgacctctcttgggagtgtgtatatattgccagataatataggcaaggtagatgaaaattaattttagtactgccctgaagaaaacacacatgcacatgtatatacagatgcttcatgtatttctaaagaaaagagatagagtttatttctggataacctattatttttcattgactccttcattacgagaaaatcatactaacagtggttatgaacactgatttcaaagttacctttgacttctccaattaaaattggtatttcacagggtttaacaagggaaaggtctgtattagtctgggatgcctgttgatgtaagcagcagtcttttcgccattttcttgggaagaatttttattttatttattttaatatctatgtattaatagaaaagtctatgtatttgaggacaaactggaaaaaggaatgaaccttgtcttcaccttgataaacaaaattaagatacttatggaaacagtgcagcaaaactatttactagccctgtttttgtaaatagaaatgatctagtaagaaccaaagtgtgatctctacttagtagaatgagagcctggcatgatcaaggctaggcttctgtgataaaatggcttcagactgtatatatgataaacactgaattcttccattaggaatttgatcgtacgttacagtccctcctacactgggagtagtaaatgtgttcagctggttcaaaattgtatcctaaaaatgtaaaaaaccagtttttcagttacaggaaaattttggccgacattatttttcaataatatttaatttataacgtgctaaaattttctgtgaatttaagtttattgatgcaattaaaattacatgaaatgtaagctgttttaggaaaaccacggtagattgggcatcacttgtttagcaaaattggaccatcccataataaattcagttatgctgatcaattatgcaccaattggccagtaaaaacacaaggccagaaaggtagcactatcttttaatcttgttgtcaaatttagctttacttataatactgataattataacaataatagttttcatttattaagcaattactgagtgccagacactgttctagggatcctaaacatgcattagctccaatttactcctcgtaataaccctataaggatggctaatattatcctcattttataaatgaggaaactgaggcacaatagaagaaagtctcaatatataattagactcaattactgaaataaaatgaaattccatgttagagattttttcaactataatgtaatttacttaatgattacacaatatcataaggaaatataatgtttaagctctgatactctaaattgttctaactctgtgtatttatacatataatttttatgtatctgcttacatcaaggcagatgaatgtattatttcttttttcttgattcttttcatatgctaattaaaaaaaatccgataccaaatatttaatgaagtattataattgaagcatcattacacagcttattgttgatatgtagttaaggacagtagcctattacaccaagaaggaaaatgcactgcagaggtgctgaacagtttttgaagctgggtaatcaaaaacattcatcatgagttgtttatgtgactgtgtcccctcttctacttcactgatcaaaccctaccttggttttattcatactgcagatgtagttaatagtcgcaattcatccatatcattgtcattcccacaagcactttctgctagggtttctttagaagacttataggaagtaattcacaataaaatatttgagcttttgggtattcttagacccaatgcagtcattcattaaagtcaaacctggagcatcactctgcccctttaggttgctctaatctctgcaggatgcttcctgtgttacacgttaaatggttcaaatgggctcagatgacaccaaagtcagccagcatgttgcagttacaaccacaaatgaccacattattttacaacaagcctttgaagtacaatgcagtgaaaagctcatgatctattacatgacctgctctgaattaaatatcactaacattctgggagtcattctgccccaaattcattttgactatcaatgtctgctctacccagtttgaccttgacaataggagtttcagtttataaatgtatcatgtggagagcagcccggtaacaaaggataaatgaactcagaagataattttgagagtaatgctgtttggaaagcctctttcaatttcttatgggcctagatatgaggtatacgtgtggaaatccccttaggccaccattctattcaatgatatggttccaacaatttgaattataggcctttctgaaaaattacttgatcaaatacatttaagagaggaacactgctttgtcaaacctggcagtatcaagctatagataaaattactacagtgcttttattatccatggtagaaaaaaaaaaaaaaaaaaactctctgtagggatcaaaaactggatgagtaagcataaagtgaggccatagcctactttcatttgttcccctccacaatggttacaagatgtactggaggtaattccagaagatatatcaagggctttagttctttatcagaaataattttcattttccagtcaatgcatatcttatttcttccaccattaattctacaatgtggtctcaattatatcagtaagaaaagtgggaaacaacccatcccgacccaaaaattttgaattaataaaatgttctttatcaaaccattatacagattaatgcaccacaacttggatgattaaaatgaccctttgttatgggaatcagcagcggagacccacagaatttaattgcaagaaagttcaaagtcatatagccctatactttaatccattagtgttgctgtgcattttggaggttaaaacctggctacaaaagagaatcactttctattacttactaccaaacggctttacttctaaggaaagcttattagttaaaactatttgatgtcattctggcttggatctcagtgccttaaaaacttttttttaataggtagaacaattcatagattctacaagttgcctttgcattttaaattccatttcaacttaaacaggatgatgacacttctgtagttcagctgagaaccaattaaaatagtaaagaatatatcaagattaattgattagtcagttgcaagtaaaatcatgtttggcttcaaaatgcttagaaaagagcagctgatcattctgcattttcagttaaaggattactattttctgaatatcacagaataatgattttgttccttcaccatcaaaacaaaacaattaaattataacatatctaaattacttgatgacattattgaaataatgtctcattttacacagctccaatgatcatctaatcactagtgacacaaaagcataggcctaaccttgaactcatctcctcgtctgaacacgatcaaatttaattcagataaatgaagccagtgatcataaatcccgcttctagagatgacacacgtctgccaaagaaagctaacaacctttctggtcagatcacagtctcctttgtgcagacatagatatgaaataagcatcatctctctgtaatgtaggtagggaatttattcttttccttgctctgtttgtactaatttgaggtagaagaaatacctagaaataaaagattgtactacaagatgtggcctatgctataaataatcccaataaattaaaatctcatatttgccaaatgggggcgttacggttatttgccttatgaactgattgaaaacagcatcatgttaaaataacaaaggctcttctgtattttaaaatgtgaattctactcattaacttgctgtggtcctctggggatctagctcaacacttctggatcatattttcttgcctaaatagaagtatgtagtaattatgtcttgttcttcatgttatgcattacctttcaaaaatgtccttatacaagaagagtaccaattataatgcacctgctgttgcaagattttggaaatccacgttatatatttagtatttgttgtttcttattctatatattctgctttgctcacaattttgtcatttgttttctctatagttaaatgcatttttgactctgaaaacctacagaatatagaacaaggcaaacatctgataatcaacagaattctgtgagaaactggttaagaccatatcgtaggtcaaatgaactctgctgcaaattgcaacttggtgtttgtgacagcctcagcaactgttgcactaatgaaggggaccttgggatttataccaatggtgattaagtctttgctgacaattcacttcaccttccacacctctacatcatgttttacaaggagcaaggggcaaaatgttaaggccaacaaagattagacaggttgtaagctttattgcagcttaatgttttttaattaaagccaaaggatctttgttgggatccccaggggttagcatgcccatagcactgaaccatccaaccagctaggtatggagaagccagcacccagattagatcctgaaaggcctccaagggaggggggcggaaatgcagcagattaaataacgaataaaagacatggccaacaatgacacagttacctcatctaattccatttcatctggactctcccatggcttgataaatttcccgcgagatttcttcaaaggcacaattattatgtagtaacctctgcacaagaatgaatagataaaagttaggttagttgaaaggaggaaaacgtggatatacccttaaaccttccacagaccaatgaggttgaaggcaaattatggatatggggtgacttgtccatttcttacatcaatgacaaatatccacctgtttgttcaattttaaaaacaacacgggaagacatttatgtgtgattgcagtgatcttgtatggtaatatcatcatggtggactgctctttattaggtatcataaacagagcaggcatagtttgttagggccctggtgctggacacatacaaggctagaatactgcaatctaccaccacaagctgctgaaccaaatattttctatgacatgaatttataagaagatgtttttaaaaggaggatatagatgaaaaatttcactcttagcccacataaatacctagtagtgctgttgtttatacaaacctaaaatgctttttatttgaattaaaaatttttaagtaacaaaaattaggtataattgcacagagtaagatattaaaaattcccttctttttctacccatcaaattgcaaatctcgaggtaagtaccgcagaaaattggagaaaatcacgacttaagggccttcaaaacagctatcactataatgacatctatacgaaaagacaaaagtaactgaatacttacactgagaacagtcaactaaaatttaaggaatgtataaaggcacccatccacaaataggtatgggttatttgtaaagctgttttgtcacttcagtctagtatatactctgctttcatattcctgtttagggattctgctcatactgatctttagtagtaactatacaaggactttgaacatactgtttaataataacatattaatcacttcctacttctcaggtattatagtaaatgcataatctggttttgtcctcctacagagaaattctctgagcaaagcctaggtatagcctataaggctacaaggactggtcacaggcaaaaagacagatctgtagagattaaataattgccaaattaaaacagatagtaatgggacgcaaagctacatttatcttaatggtggcagtggtctgtctctttttcttatttactctatgtgtcataaagtattttctaaggactccatacacttcgtggagatttactgtgaaaatgaaaacacacacacacggacctaaacatacccccatacctttaaaagaggaggccaccacacaggacaaagaaacaagaggaaggacactcccaaccctgtgtcacactgaatcacagagaccaatcacagagaccacagaggccagcaaggcctctttctattcatctcaaagcaaaacctgtaataaactcagtaaactctctgtgattaagaactctgtttccattaagagtctagagcagagctgttcagcatggtatccactagcccctgggggccatcgggcactgccaatgtcactagcccaaactgggacgcactgtaaatgtaaaagacatattgcatttcaaagacttagcattaaaaagagtgtgaaatatctcagtaataatttttaaaataatgatacattataaaataatctggatgtattaggttaaataaaataaattattaaaattaatttcacctgctttttattttttcactgttgctactagaaaacttaaaatgtcacatgtgactttcattatatttgctggacggcactgctctagagcattctggtgaagaatatggcacttggagatatgtctggctgggagtttgggctgatctttggcttagaccccagaatctgttatatattctgaaatacgtgagtaaaaaataccaggctgtgatatggggggaaataaaccagaggtgctcagcacagtgtgtgtggcatgtagcagtaaacagataccagctgctactggctagtatgaacatcacaggccggagagacgcatctgaactatcttattcagtaagactgcatgaaattccgtgagctgcaggttaaagagcttgtcaaacttcttttcccctaatggagaattcaactcaaaccagacaactataccacaatgctttctccatggtgccctgagcaactaatcaacagatacacaggattacaccagctagccattcattttctttactacaaacaatcataatgatcaaggaggatgaggagaaggcagaggcttctctgcgtatgacagagaccaatatcttttatgttatgatccagagtaagcttccccctctcctgtcctcccaccatctgaaggatttaccgaacaagtccatcatgttaaatgagcatggaggagaatgacagaggctgcaactgagcgtacaaaatcacactgcagatgtgcttgataaacacacttgtcaaggaacctcttgcttttcactaccaacttctcaaagtcagaagagcgctacacataaagcaatgatactgcatattatcagagtgctaccattgtcctccttcagaatcttgtaaatcaaggttaagctgatgagtttcattaattttttcttctgctttcatactttgagttgccattcttgtacatgaaaaaaaaaatccattctttcttcggcagcactcccccactattcattttacttgtggctgggataagaattgaacagcctcccccacggcaattaattaacggtgcggcaagatatccacaaccttttttctccgctgatctctaaagcattcatctagggcagtcaaagtgaagcttgcttcaaagcagctcttgcacattgaaagaaatagggcagtggcaatttgaaattctgtatcatacaaagcctcacctcagtctaaatccacacatttcaactgtgctctctgcaactatagctttgtaaatatcaacttccttgccttacccgcaacctgtctctcccctgagggtactgcttcctttgcagccttctcatatggcagctgtggatctatccctcctcccctgcccatgaacctcagagtcagggtttggggtttctttcctggcttcccatcgcttcctgcaggtatttttcttccactctcttgcttttgtagtaacaaaccccttcttttttgaagttcatgcaatccagctacattatgatcttctctggctgatttttgccatctagtacctcccccagcatctcctttctctcagggaagattcttttgcggggttcatggccttcttttttctccaaactctgtcatcatcctgggtgatttcaaccttcataggtcgggcccacgtaccactgaagctctcagattcttcaattctccctttccaaagcccgtctcctccactctaccttagctgaaatctacgcttgccattctctgtgccagaatccagggagctgaacacagcttgagaaataaagcacagggcagaataatgccataaattcataatcagcaaccccagttaggccttcaacacggcctggcaatcttaccactatctagtttcctaataactgctccaattgcctagtccttccattttccacagtaacattttcactttctcctctagcctgaaaccctggacgttcaaaccaccccactagaagatggcctcatctcttatataaagagaaaatgcaaagattcagacaagaattccctcatcatctgtctaccaaagtacaagtctatctagatctgtaaacaaaccacacattttcttttggtaaagtagaagggctggccctacttttgaaggccattaactatttcttgaattgttttcaatcttctcactttcttaggaagtttaccatacattgtactccttctctctcatatatctcaacttctccttccccatttgatcccatcacttaggtttcaaccatgtacaaatatgtgtcatatagagaacaaaacaaaccacatcccactctagtcacctctctttctcccactcctgactgccaaaattctgcaaatagctgtgtgttcctgctgctcccactgcctccctttcccttcacttcccagctgactaggctttagcgcctgcctcctcactccacctcactgccattgccagggtgctcagtgatctccagggcattacatcaaaaggggagtttctggtactcttctgtccttcttgccctcttagcagaccttttaagatgttaacactctccatgaaacattctgagccctttctctgtgatattcttctgttatttctatgtatatctccttccacactaaccttatttccttagcagaatttatcatctgcggcccagctacaatggtgacactcctcaaggctctggccaagaacttctatccagaccctattttcatcctagatctcattccacctcagggcatcagttcttagctatatgcaaatgatttccagactcatatctttagccaagaatgttcttctgaattccactggtttatctgactttaagttacaaaagtacccccaatttactgtggttaaaataaaagaaataatatgcctttcaaaataaaccctccctaacattgcactacaatccatttcagtgcacaagccagaaacctaggtgttatcattgacaatctgcctttattctctccctctgtcatacttaatctattgctaagttctatcacttccaaaccctatctccagtgcacgtgcttttctccatctctactgccactcttctggcctcattccatgtcttatgcccagactgtgaccttactctctcaactctctctattgactttagccccgtctagtgcagtctctgaaattttcaattcacaatacaaaatttgttctgccatttccactttttaaaacatttcaatggatcctcatttctcttaggataaagactgaaaggtatcagaaggccagcaggatcttgcctgaatccctctgactgtgccctctcagctacagcttgataggctttcagtttcttgcatttaccctagtccagtggttccgagcctttttggcaccaaggactgattttatggaagaaaatttttccacggacagggtggggattggggggatggttttgagatgaaactgttccacctcagatcatcaggcattagattctcataaagagccggcaacctaaatccctcacatgtgcagttcacaatagggttcatgttcctgagagattctaatgccaccactgatctgacaggaggcggagctcgctccagtggtaatgctccctccccactgcttacctcctgctgtgtggtcgggttcctaacaaggttaggaattggcacccattcatggcccaggggttggagatctctgacagtccattctgtcattaaactatcgatcattctgttccacctgcctagaactttctgtcactcccacctagttaactattctctctccttaaatatctactaactgattattttctaagtgaaatcttctctgattttttttaaacctattacccccattatatggtctctatgaaccatttttaatctatacattttcttatacaacaaatttatatatttataaaaacattactaaagcagacatacatataatacccccaacatttgcttaactttgctattttatcatggaattattcttccactgtaaagaaagtgggtacaagaggtggctcttaggaattaatgcctctcctaagtcaggcagtcaaaaatatttggcggttcttctccatcagaattttcaactctcagtctcatcaagctttttctcctttcttcaaaccagcaatggcatgcccaaatagagtttctagaaaatataactccttattgcaaacgttcttttctttactggcctactcgtgacccttgttctaatctcacaggacattaagaaagataagatgattcatattggaggagtgaaatgggcagctaatatgtgccctacaaattcatatcaaccaaatcatatgagctgaaagaacttgcttgaaatgaaaaaaaaaaaaataaattgcttttggagctagctttatatatgggtaaaattaaactcaatattctgctttgcccgtctgcctcaagcctggagtttagactcaaaacagcttttcaacatagactttaactattaaagtaatagaaaaataaataacttcagaatcaatatatctggaaagcccttgactacttataaagtaagctgtgttttcccagtatattagatttaattagataagttaaatctaaccttcagagttttaattatattaagtaaagttttactgatttcatttaatatgttatcatcaaggggcccagttccccataattatatgagaaggcaagctctggtttttgtggcagtcccacttcaaattcagtcaggctttttgtgttagtgtgtattagcattctcaaacatgttatttaactgggaggtgaaaagtccgtctaggagtttaatgatgaatgtcattccttgcgtaagcctcctggctttaccgctccttaaattctcatggcaacccactgactttattgcttcatgacactaaacacacacttctgtgatctgtacccaagcacatatgcctggtcactcttagttctaaggtttgtctggggcagtcctgtttatgtctacttcttttggagttttaatcagttatcaattgacctaggaaaaaaaaaaattctattttgaccaataaacttatgggcacagaggcagggctgtggttcagaacataggctctggagccagactgcctggattcaagcctttcctctctggttttgtattgccagctggggcaagtcactgtatgttgtgtgttcctcagctataaaataaggagcaccattcctgtgaggattacatcagttaatgtgtgtaacatcctttgcaaagcacctagtatgccctctgttcgtattaaccattactagtattagctgtatgatcttggccaggacacttagtaccattggtcctcattttactcatatgtaaattagaggaagaatacctacctcacagggttattgtgagtcttaaatgaaacctaatatcctcagtaaattgcaaagtactatacaaatttaagcctttgtgagttaaagtaatttaactcacaaacacatgattaattactcttcattaggctgctaatagtggaacacaaatcttatgaagcaacactgtaagccatgcttccacaaaaatcttcttgtttaaaagaaaaagttgagaacaaattagtaagaccaaagaaattgaaaatttcatagaatacccttattctttatttcaattttttataaacataaaacggttgttataaaattaatttacattgagtaccttctggtagttttttctcctagtataatctgtgttgtgcattttttaaatacccagagtaaaattctgctctataaagtcacagaagttccctatgtcattacaacttgcttctgaacaacagtagcactgctagatctgactggcattctgctccccaaatctacttaaatagtaggtttaagcaccacagaattcctgataccagaacttgcagtatccttaaggctgttacaaaagaaatttagcctttctgtgagggaactctcctgatgtggcacacaaaaaatacaacaaccaagtatgaaagtaaagagatattaaattaattagaaatcattagacactttttcggtgttgaggagttaaggagtaggggccaagacctcctcattaacttggccagaaatgacagcatggtttctgttggtcaagaaaacaggtgtcaatcaccaaaactgcattttgcttgaaaacaaataggaagcatttttctggatagctttcatctaaataaaagttagcaacctgcccaccgttctggaatgagttctgtttcttcctcacattttttctaatagaatactgaataaaaagctacaacctttcctaatttctaaacttgccaaccacggcaagtgacacagcatggcacggagcttcttgtaatacctgaccgtgttacattaaccagtctagaaaacaggagtagtaaccttacactattatccctttaagaattccaataaatagaaatcatctaaggcttttcactacaagatttgcttttcattttccatttctttgatacttttctcactcaagtactttcctgatttagtctttcactcatttcttccccaaagtggctgtaatatatttctgagaatcttttattcattcctagaaaacaaaaaatgtccaaaatagtttgctttctttttctgctttgtaatggtctcatttctgtgatgtcaaagttttataccttttccctgactcccttttcaaatatagaagcggaaagtgcataaataaaacaaaaaaaattgaacaagctaaaaataaaaactgacaaaggtagaaaacattctgcaatattctcaactccttcagaaattggaaaatgaaactaaagtttaccaccaatggactaaaagtgccaatttccaataatagctaacacattctagcaacacaatttggtgaacagcctctaaaaggtcatttttatataaataaaagaaagtattgaaaactaaattaatagtaaatgctgaagaatatactatactattttcctctttcaactgctcttttcctgaagagacatgcatgtttttttaatggaatgaatttatagtctatcatttccctgttccttcattatttgtaactttttcacctttcttaaatctttctcacactatcagactcagattagatatgatctccttcaggaggcctcccctgacacccaaattgggctaaaacttgatatttatgttttcacaatacctggcagtactcaccccattatattcacattatctattttctgaatctattctcttactataaggtaggacttaatctcagtcatctttctattcccagaaatagtcctgacaaaacagtgtgtatagaatatatatttgttggatgccagcaggaaagtcttaagaggtagacaagtacaacgtggccaaacaacaattgctagtctttctcttgcctctacaccatcagagacgctctatcctctgagtgaacggctgtctctccactcccactcccatggcccagctaacttcctgtcactttttaagcctcagcttaaaaagcctcatttgtcactttctctaggactgctgaactaataagccggagttaggagcctcgtctacagcctcccttatctatctaattttctctactataggactctgcttcagtgaactctttgcttgtccaaattgcccaattaactatgctgtatgagaacaatgagaaaggacacactgtcgctactgaatccctgaaacattaacgttgactattagggtatgtgatcaagaaataactgatatgtctatggccttgatggttttataggtaaatacgtatccccaaactcattgagttgtatacattaaatctgcacagtttcttacatatcaattatatttcaataaagtggttttaaaaattcataaatatcctttatctgtcaagatcaattaataaacattcagaatgaatacacaaatcaaggaatataatcccgctgtcatactgaaattgcttgggataaaaattacacaaatactccattctcattttcagatttctagataatagaagaagggccgggcgccgtggctcacgcctgtaaccccagcactttgggaggctgaggggttggatcacgaggtcaggagatcgagaccaacctggctaacatggtgaaatcccatttctactaaaaatacaaaaagattagccaggcgtggtggtgggctcctgtagtcacagccgctcgagaggctgaggcaggagaatgacctgaacccagaaggcggagcttgcagtgagcagagatggcgccactgcacgccggcctgggcaacagagttagactccgtctcaaaaaaaaaaaaaaaaaaaaaaaaaaataagagtagacaaatgtgaagactttattttacactgaatttattttgggaataatgttttagaaattcttttcactgaatttattttagtaataatctttcagaaattcttttcactgattttagtaataatctttttgaaattctgtcacctagttgaaattcatcaattattttatcaaataaacaataattgaaagtgtacccaggaaaggttgttttaggatgtgtatcaggtctgaatttattaattatacctaaattacacaaattatactattttaaaacttcttatttctgattttgttttttaatacctgattttctcagccatctgctttaagttttctggagtttggggagtttttgaccactttttgaatttttctccttctagaaaatccctttgccatgctgctctggctcagttctcctgttagatttctaataatccctctctgtgtcctctactggctctcttcttcctattaacggagacctttattttagtcttttgcttcacattttcccctcattgcttcaatgattctgtcttcttccacgaaaccattgctattttgttaacaactcctaaatgcatatctataatctgttttgttttgttttgttttttgagacggagtatacctctgttgctcaggctgaagtgcagtggcacaatcttgactcactgtaatctccacctcccaggttcaagcgattctcccgcctcagtctcctgagtagctgggattacaggcatgcgccaccatgcccggctaattgttgtattttcagtagagacggggttttgccattttggtcagtctggtctcgaactcctgaccttgtgatctgcccgcctcggcctcccaaagtgctgggattacaggcatgagccaccatgcctggccatctttaatcttaataacttctctaagcccacacttctaactaggtatttcactgatatttcatattaatacacacaacgttaaactcatttacttctgaatttttttatcctttaggatgacaccatcattcattgtcatccaagctcagaactcagagccatattttactctcttgatctcatcattaaagcagctaccaataatgtatgctgtactactactctagtgtaactcatgtctacctctgcatcctacttccatcatcatcatcttcctttagaatcttgttatttgcctagagtcaactatgtgaccacctcccaataattttctctaccactatctctatggcgctcccatctatccaaattccaacaatgcatgaactatgaataaatgcctctctgcttgaccttcaaacctggcatagcaagtttcacctaaacttgagggtgtgagatagaagaaatgagaaaggatttattcttattccaaacaggtagcacaatagatgctcaacaaatatttcctaaaatggaattttattatgtattattgaaatgttatcatgccactctcctgtgtaaagagctgtaatgggttgccattgtctagaggatatagttttcacttctgggtatacccttggctcttgtatgcctccttcttccttctcttgccacttgtggccaggcgctctgggatccagccgtatggcaccactgggtgcctttagtaatgggcctatgcacttaccactccctttgcatatagtctctcttttattatttgtatgcctcctatttatcccttaagatttaagttcagaaactttattgacccattctgaattagctgctcttaagataaagcataattctatcattaacgcttactacatctgtctgtttctctgtatctctctcactctatggtaaggtctttgaagtcaggaatccatctttttttattccccggagtctaccacagtacttgtagttcatatattttggtgaaaatacttttttcttctattagttattcaaccaactagctatatgtccttggacaaacttatttaattgactggatttaattttccacttcaggcctgttggcctctatgctgtgctacattcaaaccagaaaacttgaattttctaatgtttatattttttccaatgtcatttttaactttaactttttggaatttttcctacttttaatacatcagtgtcatataccattatctaatttccccccctttttttcaaccttttagtactttgtaagacttcttcataattacaaaaatattttgccaaatattagagttaatcacctattcaccttattccataaactatgacataaaatgctttgtagtagccgggcgcggtggctcatgcctataatcctagcactttgggaggctgaggtaggtggatcacaaggtcaggagattgagaccatccaggctaacacggtgaaacccggtctctactaaaaatacaaaaaattagccagacatggcgacaggtgcctgtaatcccagctactcaggaggctgaggcaatcccagctacttgtgacgctgaggcaagggaatctcttgaacccgggaggtggaggttgcagtgagccgagatcgcgccactgcactccagcctgggtgacagggcgagactccgtctcaaaacaaaaacaaaaacaaaaacaaaaacaaacaaacaaacaaacaaacaaaaagctttgtagtaagaaccatgttctatatgtttttctgtttctcctaaataacactgtccctgcaatacagattaaaaactcactgttaaattaatgaaaatctgtgttacaatgaatactaggacacgttgtaaaagaactcggatagcaaaactgggagtctgagcagaagaatctttcactacattaagcagtatcttcttttacgacctctataattttgagatataatgttcctatttacctataattctttccttcagccctaagccttcaatcaacttactttatattctcatttgcaggtacttcaggcagttgcacagtaatcatgccatccaagttggtcttcccaatgaaggcaggcttggtacgtaatacatctggtgcagtctttgccgtgaccctgtgctgcagcccaccagcactgtttccacgatttgtcagcacaaatgaatatgatttctcaggcttcaggttgacaattaacttctgtgtggctcggccatccacttcttctaccattttcccatcatcataaagaatctaaagagataaaaccaataaaaaaaaaatctggttatcagagaggcaaaatatattttctaaaccaatgtgcactagcttttggaaaatgtatatatagtcaattctaattttaggtgatttctaagtccatgagtagtcataattctggagatcacatcaattttcctgtcatttcctactgtgtaatgataaaatgtttccaagtctatcaaaaatacacaaagatagatatatacatatatatatatagaaaataacttatcaatattagacctgtcagttgtatgtgatcttaatggaatatgtgcagaaaagctctacgtttcaacgtattatgaatattgcctattttctaaaggttttggttcctctttctaaatatacttttactttcaaaaatgtttctctatttcttatttcataaatatgtacttgctaacatctcttaatggcaagccagagtttaaaatgtgccaagaatacaggccaacaaacaaattcagaaactcccagggtattataatataaataggtagaaaccatgtaaatttcattctctggctgaaaaacaaaagcactagcttagatgtaaaaagttcaagttcaaagtagtaggtaacctacaagtgatgccagccctggatttaagctcctgctccttcttcagagtgtaaaggacacacttacaaagcaccaaactgtctcccatgtgaaagtcacaaatgaaaatagcaaggacacgtggccaaaacaaagtggtctgcttgctgtgcaaataacttacccagataaactgtcccctctacttttatctgtgatttcttacaaattagaaaacaacttactttgaaaggcatggcggagttataattctctggaatctcccaagacagcaacacggaagtcttcattactgctttgacatgaaaattttttgcaaacactgctggaaaaggaaaaacagtgtatttaaactattcttaaaacagatgacctgtcctttccaccatggaccataggggcttatgctagatgctgtctactttgatcagagagagaagtatgattttcctacctgtttagagcattcattttaataccccattctcacagagatctttcctttctctccaattcagccaactctattgtgttttccttacctgaggacattggggtgctgtcagccagacttgcttgacattctataactgaaatctaaggcatccaagacgtagtaagttttacatactttacctttttgtttttgctgaacctattaatatgaatgggctgatcagttattatagcttcaaaatactgatttccaaagactgacaatcctttaaaggaggaaggccgtaagcagacaaatcctaccttgatccacaggcagtgtcctgaactggacactgggactatatggcccgggccctttgctcgtatgagcacgtacttttacatcgtatgtggtatctggttttaagccagtgagtgtcatagtggtgtcagctggaacaataagctgctccatcgggagaagggggatgttgatatccctataaagaagggtatacttggtgataatgccatttctctctgccaggacaggtggttgccaagataactggacggaggttgaagtggtgccttctgagtgaaggttttgagggaatccagttggtacttcttctggaatggaaatctccttcaccatctcctccccaaagcccactttgtttctggctgagagcctgaagacgtatgatgctcccttgtggatgtctgtagctgtaaagtgatcttctttttcagagaactcaagagtagtaagtggctccatatccttgcggccaaattttagacggtagccctgaagaggtccaaatgtgtccaccggagggtgccactgaataagagcagtattcatctgagtgtggttaatcacaagccgaggtttccctggaactggagcacatgggatggagtggtaagaccaaccaatctgaacgttcacatttcagtcattgccaaatgagggagttccactctactggtattcccattttcttacttaccaaaacaaaacaaaacaggcaatgtttgacctacatacctttgtggaaatatgctccttgtcttactttattaaagtaggctgagatactagaatttgataatggacacaaaacagaaattatcattgaaacaacagcttaaggggatttttttgacacctgcacgttttaaaccttcacacataaaggttcatatcaaagataaattaatttgagcaaagatcagccaattagatatggctaataagaataactataatgattatttattcgttgaatatgtgcaatgtaccggcgtcacgctaagtgcattgcatatagtattcacaattggtttacattcctgactcctcactacattctcggattagttattattatctctatcttctataatgagaaaatgaggcccagagaggtagaaaactttccaaggctagcatgtaacaagtgagaaatctataaggcaaacccacctctgtctggagtcgactgcttaaatgcttaattgtgctgctatgttgcttaaaagtttaaaaaaaaaccaaactacaaaataatatcgtattgacttactatgaatttaatttgcactttctaactttactatccacatcattcatcaagttcttcatctgtaaaatgggaattatattaagagctattttatattgttcttatgaataataaatgaggaaattcatgtaaaagtcttagcatgaggttctgcattctatcaatattaaccataattattaataatctgaatattaaacttcttatggtgaaaggctagcttccaatgaatacataatttatttacctttaagttagatatgtgaaaaggtctaatctactcattcaatgtattattatgtctgtatttatttttaatggagagcaattattattggaatccacagtgaaagacattgagggatgatcatcagaataaaaactaaaccaagttaacagaaagaagaagaaaggccaagtatggtggctcatgtctataatcccagcactttgggagctgaggtgggaggactgcttgagcccaagagttcaaaaccagcggctgggtgtggtggctcacaccagtaatcccagcactttgggaagcagtggatcacctgaggttgggagtttgagaccagcctgaccaacatggagaaaccctgtctctacaaaaaacacaaaaatagccaggtgtggtggtgcatgcctgtaatcccagctactcgggaggctgaggcaggagcatcacttgaacccgggaggcagaggttgcagtgagccgagatcatgccactgcactccagcctgggcaacaagagcaaattccgtctcaaaaacaaacaaacaaacaaacaaacaaacagcttggcaacatagcaagaccttatctctacggggggaggggggaaggcatggtgtcacatgtctgtagtcttagccactcagggggctgaggtgggagaattgcttgagccaaagagtttgaggctgcagtgagctatgatcacaccattgctgtccagcctgagtgacagtgaaactgtgcctcaaaattatgaatgtgaagaaaaagaaagatggtaggaaaggaggaaagcttacagtaatgggaaacaggtgataaaaaatcataccatggggatatagatgaaggtaaaaaaatcactaaaaagattatgagacaatacatagaatattaacctcagagatggactgattagcctcttcattttgtatttcagaaagtgaaacccaagtggagatgtgctctgctctaagaaatatcattaagatatttatttccttaaccaatggagcaacagttttgtttcacatgctgggaagattcatcacatgctgatataactcagctaatctacaatgtatgaaaacaatagtttctaaagtttttagataaataattattcaacaacatgtgtgctgtgttatacatataaaacatgtgtgttgtgttgtatatataaaacatgtgtgttgtgttgtatatataaaacatgtgtgttgaaggtaggcccaggaaccacatcattgtgtactcattgtgttcctcaggaaaaatgcatccagagatcttaacgaccaacacacactctcagaacaccacccatccataagttggaaactgtgtgaactattccacttgcttttaatatatttacaattatcttaattttaaaatagtactttaatgtagggacattggcagacatctttaattcccctttatgtgtatagagcatttacatgatttgtccaaatgtcagtgatggtgtcaaggattaaacacctgagtctctgctgagaaaaatccatggtgaaatagagctttcaacagagaatacagccttcaatatatgaaactccgttgaaacgagtgggtggaaacacaactattaattctcaatattctccagaggcaacagattaaacatatttattaaaattttttgaaattctagttccaacgaactgcataataatatatacaccgtgtatcctgtttccgtgagatgcacgtaaagctaggataaataaaaataattttttgatctaaaccacaaatagagactgcattctaatatttgtcatttatgagcatgttcttagtaactgatgtttcactttataatattgctatggtacacatttggataaatctaatgggctggcaaagtctaggaaaaaacccactgactttgtagatgtatacatttactcttctgtgggagttaaagcttaggatggagtaatctcttttgtttttgatgttggcatgacctttcttatcctgggacagaaaggcttgttggctaggaatcacgagatcaaagtaatgatatagaaataagagcattagctctgacctactggcttcccctgctgtacaggaggatctcagtctgctctctattgccaaacccacaacagtcattccttccctgggcagaagttttactaagcctgaaaactatgagacaaccagcctggaagtgccacaaagcataaaggaaggactcagtaaagaaatgaatgcttatgcagcttggggaagaacacccaatatcacctcaggagaggctggccacatgaagggtcacacgaagcgatgcctaaaatttccataagcatgtgaataatagaaacagtaaatgcagtttaaacaggctggagtaagggtttgggacagttgtggtattttatccagggaatcaggataggataaaaaagggaaaaggaatgaggagagttctacatcattgaatacatagttaaaaagaattctcccaaactccacagattggcaatggaactcactgcattcctggcttccagaaacactataggtatcaaacatttaccaacaattcactttgtgcaaatacttgtacactggcacacaggtagttgagtgaggaaataaagacggatgcagcagggtccatgttctctaatacaggcatattctagttgggaaaataatcaggtggaatagattgtgcaatctgtggagtcaggtttctaatgccttagggttattctgtagactacttttataagtcatgccagctgttggttcaatggttctgctcactccagcactggagcttgagggttggtaagatgaaagggtcttaaataattactcaggggagttggaaggtcatttttcagcagggtcttaatgaacacattggaagaagcagagaaggtccagttacaaagtaaataactctaaaacttacgtcatgacatataaactcttctcccttttacattttcttattctcttacattcttttaaaaatttcctaggacttcagaattggtacgtatgtgtggttgccctttactttttagcaattggaatcattggagatcaaccgaggtactcagtcccagtggctctaaatttagccccaatttaaactagtaccaacgcaacaacaatcacaattgactagacttgggctaatatttccaaattctccctgtcacagtcatcttttgattatccttaaacatagctgttcaatatagtactgaaattcatgtaaaaatatacagaaaatgtcaaaccaatgaattttctgtttgcctttaacctcaagaactcagacagtaaactaattattacaatacagaataatgggaggattaacaaagaaaatacaaatatttcataagcattgaaacataagagccaacattttcttcagaagcatccttgaggttatatgaatcttacgtagattacttaaattatgatcagtactcgtttccaagatatgattctttacaggttgtagaaacaaggtataataaacaaatatcccacaatcaggaagtttactattaaaataaaatttcacaagaattcctgaattctttgtgggagctgtaactaaatacctttacaattatggttattaggagctcacatctgtgagataaactcagtaattcttcacagtcacataaatatacgaggatttttaatacagtagacaaaacaaattgatatattcactaattgcctagggataaaccatgagtagcggctgcttatgcaaaggaaaactagagcttcgctcttaaaggaattaaatttggattcttctgccttcttcccagatgcagtggggaggtcttacaaaagtaaacgtgtaggcatctaaattacaagcattttctatctcaataccgaagcctctattgattaagaaggatctaaaattgtgaatgaaaattccaaaggaattctatatgtgaataagttccaaaattctaaaatgtctactgcatggtaaataaaaagggatgagctagccttagtgacgttaaaatagacaaaatcattcctttctctaaaattcatattcctcggctataaatccactactttcttgtcatcataacatgaccccatttaatgggcaacaggggagtggtgcttcatataaaacatttcagagttattatgacatatttataagtgtaggtaaataaaatgtattttcttccatttgagattcaattctttgttgttgacgttctaacagagactggatccacagccagatagtcatcatgccatcatgcccctcactgaatacatgcctgctcttcagggcattaaattagcttgatacaatggtatttaaaaaaaaaaaaaaaaaaaagcccagaagactcagccttgaaggagttttgccatctgtaatcctgctgtttgaggcaattccaggtggcaggatgcgagcgaggcaaatcttatgacatttagacaaagctggcagtgagcatggcacgcaggagggcactcaacatcacagctgttctttactttatgcctttacatagaggtatgttcctaaaaagatatttgagaagtgattcgggcagagtaaatcaaatcatggtttacatgttcacgggagattgccatatatgaggattgaggagaatccttctgcaattatctcttaatttactcattctacaatgccagattttccttcatgctggcttttcctactgtggctgaccaaagtcatcctaaaaagcattgaagaaaccttattctttagaggggagtaattttatactatttagccttcttgcttttcttctttttcttttttgttttctatcttttgttcagtttggcttctttagaatccccacagcagggggtggggaagacaaaatgacaaaaggtagaactgtaagtcatgaacccagttcaagatggcagctcttctaaggggatttgttttccagggaagttgacattgttgcttgacttccctgcccagatcccttccctccagatcttcatgggacttgatccttcacgtcatttgagtctcgacttaaataatccttcctctaccagaacttctcagcccctagaggctgcctgatccttaattgcctatacgcttttacttttcaccttaccactttctgacattttattatatactcgttttgtcacttgttaattatctagtcctattcagaaagtgaatttcatgagtgtagattcttgttctgttttgttgattgcttcatccccagtgctggtaacagtgcctgacacacagaaggtgctcaaaaaaaaaaaaaaaaaaaatacttattgaatgactgattgaatagtttggacaaattatgcacttggactatttttttccctgatctatttttttttttttacccctgaactaaaaacacaaaagttgaccatagtccatttatttcctctgattttactataataaaagcctgctagaagctacctataccatttaaaaagttagtattactgttcaaggcacatacatgcacagacatgattacctgccccagtggtggacaccagtttgggcttgctgcgagcaccatctcctttggttgtgtaggctgtgacggtgagggagtaggaagtttcaggctggagcccagaaatgatcatgtcctgaaatgacaaaatagaatgtcactgattcaaaacatgctactaatgctctgggggaaaaacaaggccgtctgccttcattctgcaaatgctcgcacatcccttgcagccatgctaagccctggaaatttcatgcctgagctcatgctatggagatctgttttcatgctgatatcgaaggggcatcttcaggcatcttgggaggtagatcttagggtattagtcaaagacatgaaatctggagccagacttcctgaattcttaaacttaaacttgcatgtccttactagcttggacagaccaagtatgtttacctatctgtgcctccatttcccatctgaatgttggaattataataggaccccataggattatatgagttatatcaggtaaactcacagaactatgcctggcttataggaagcattccattaaagagtgattattttatgccaacagctctccacacatatccactgtaacccacagactacagatggggctgatgccagcatagtctgttttatcactatagacgaattttgccaaatggttgttgttggacctagataccctgagagagaattttcttaggactctcttattaatggattgtattatcatttttattggttatttgtataggctatgagcagaaatcattatccactgaggagaattttcacacacattaaaaagcagccataaaagcaaagaatacaacaggactttagttttaccacatcactagtatgtgctcaatttattttgactttctaaaaattgttaaatatcacatactatttacctaaattcttagttttctcttagtcagggcccaaagctgtggtggttataagaccagatgctctttgatatattcctttaaactgcaggttatgggattctttagagattctggctattagcttattctagtattttaagaacaaataccagagctgcatgtacacatgcgcgcgtacacagacacatgcgcacacacacagacacacacagacacacagacacacacacacacacacacacacacacacacagcaatataaaaaccctttcagatttttggcacagctgtgttttcaaattgaatatggataaatttaggaaaatgcacaatgtcattgtcttccaaatctaaagacaatgtgagtgacgagtacgaattatattgtgtgaaatacagtaggtttttttttagcaaggctgtaacagataccgtagagctcaattgttgaagctgatcccaaatatgacagtttctgggaacatgctttctcaaaagagtaggaatatctcactgtggaaattcaagaagttcagatatcatcctgaagagtcactggaaattttattctgccagataaatggactatttgggagaaatgttgtatttccaggaccttggaatggtttccctaacattccagaggatagaaaaaccaagtaaactacccaagagcagtattttaaatgacagcagacacactggctatcccaaaaactatcatgagtaaatgccaacattatggtttccaaggttcccctcacatgccactggagtactgctgaaaagcagtcatggctaactggaaaaagcagcaaggcttgcttccatcaccaaattttgtagcaagaaattatgcactctgagacttatatgtttcttatcatgaaattggagttaaccacacatatccattatcttgcccaggttgttagaggataacagacataacgcaatttgaaatgcgtcaagttccctgcagtggtataatctcggctggacacacctccaactgccacggtcatatcctttcttggattacattttctttctttaagtggtgggtgcacttccttccttggttgtttcagtatgctctgtgaggtgatgtgcctgatattatggccataattcctcattctctttgtttcctcctgtcctgtctccactttgcttcttgtccctgactgttaaaagttggcatacctgaggttctgtcacagtcactggtctactgtttctctaatcttaaaaaagaaactgcattcatttctaaaccttaaataattatttctgcccatattcctgatttatttccagctgtgacttccaatctgagctccagtggcatatacattgtaaatatctgctagatgttttcctgtgactacccagtgttacttcaagttcaaatgaactaaaacttaaaaatcattcctggaagtagactccccctccttacttccatattttaatgaacggtaacacatctgcaaaacttatgagctatctttgacctctttctcttcctcagttcttagcaagtttttgccaattcttccttttattgatcctaactatcactttttcatttctactgcctcaactctgttgcatttttatcacttcatgactaaattagcaaaataactctttttacctgctttcctatctgccacctttttactctctaatctatccactaagtcactggattttaaactgcaggtaatgacccatttagtaggttgtgaaatcaatttagtcagtcatgaccagaatttaaacaaagaaacaaacaaacagaaaatgaagtggaataaacttgaatacttaatgttagtgtttattatacatttaaagcatggttctataaaaattttattttagttaaacagaggtgtgcattgaatcatgacatacaataatgtatttcttactgtgagttatagtcaaagaagtttacggtcaaaaatgctgctgcactggcaatcccatgagaactgataccttgcacacagttacaagattcccaacaagagccatgtgcattggcagtaaatattcattcagtgaatggaagaataccgtcttgccagcctttaactcatttttctttttatttcttctatatcactctaatattgaagagttaaagactgaccggccagctttttagcttgactcttctggttttcccagtattatattatagtttacctcttagctctatttaccactgagttacttaacacgaagccttcatttatatcaaattgtcaggctcactgtcacgtgactataccacatgctcaactgtctcaatgactggttttgctgtgatcaactttaaaaaatatgtatgttccacctccaactctccaacacacacacacacacacacacacacacacacacacacaaacacacacacacacacacactttttcacttattcagtctttagtcatcccttaaattctcaactaagcttcaggacttcttttactatcttggaccactgtctctgaattcatagcttttattgacactgtccactaatttactaatgcatggtccactgctgtaggccatatattttgctgcgttctatgaaacttttcagaactttactcttccctagccacttagaatgtaaacactagaaaggcaggtgtcacatcatgtgtcccttgcagtggcatatacataacagtccctcaataaataacatagagttttcattcaaatattttaaaaacattcctccctcagcgacatactttctacttcttggcataatccattcaccattcaaatatgtatgggtaaagtgaagaacagccacttctagttagagttaatcagtgccagatctatatcttgttatctactggatatgcgatcctggagtcagatttatgagcattatgagcagcctacaccaaacaatctgacatctccagtctgcaatgccttcatttaaagcaggcttatccaacatgcagcccaacacaaacttgtaaactttcttaaaacattatgagatttttttctgttttagctcatcagctgtagttaatgttagtgtattttatgtgtggtccaagaccattcttcttccaatgtggcccagagaagccaaaagattagacaacacccctgtgttttaaagcatgcctcctctgactgtcacaaggcagagttagtagcagccatcaaaacaaatatcacaagcccatgacatttcttacgcagtcaatagcaccatgctgatttcacaaaacaaaaaccaaaataaaaagtgcaccacacagtgaagataacttaaaaataatttgttagttcatgcatccaagcaaactgtgatgacagatcacaaataagtgaaaggatgtcagagaaaacaagcatatatagtctgcttttgacaaaacagtcaaaaattactcacatgttcagtagtatcatcaaattcccactgattgagaataagaaggttgggaggaaaacaaaataaaaagaaaaagaatttaaagccttatacaggcagtgttgcccttgttagattaaaaaaatcaaaaaaataaagcagtgtgtacaataaaattccaaagaatgtgtgatttgctgccacctccacctctgattgggaagtcaaattaaatatcctttgttactgttatcactaaaaccagctaacattctttaaatgtatggttcactgaaacatagcaatgaggcacagaaaaagttaatgtttctaatcatatcctactcgtatttattttgacttctatcttaagttacacaattaaaagtcactatttagattaatatctttcattatatttgacacttataacttcaatgaagtcctgtgagatgtaatgaaatttcagtgaagagtcaaggaaagtaaatgagatgggaaagaaagaaaatacacaaggaaaaacagcaattaataaagaaaagccaaagaagaagagaaaaaaagacagagttcacatttaatgcatttggtattatataatttcgttaactaccatattttgcaatggaactagggagagaattacagttctgtaatgtaaaatatctaagaaccaaaggagaacaccaaagcacactggtcatattgttttcttttccataattgtagacttacaagataaaacgtagcaatgatggctttaattttatactacgataactttctttttataggcactacataataattatttatacaaatcaagtcaatggcccctttccagtgttgaaggggtattacgaagcactactgcatttacagaagtggcctcggggtagataagtgagcaatgaatccagatccctttacttagaatgtttcaaaactgaagaaaacataaagacttctgagagttgacttgtattaagactttgggggtaagtactttccttagaggcacagggatatttattgctgtcttatttttttatttttttaattttattttttgagatgcaatcttcctctgttgccaggctggagtgcagtggtgcgatcttggctcactgcaaactccacctcctgggttcaagtaattctcctgcctcagcctccctagtagctgggaccacacaggcgtgtgccgccacgcctggctaatttttgtatttttagtagagatggggtttcaccatgttgagcaggatggtctcgatctcttgaccaggggatccgtccgcctttacagacgagaacgtagaactgggcaacctggtgccgcagttttcaacttgcttcataacctttccaactttcacacaaagaaacgcattttcatttgaaataaatttcaaatgtttttacaaactccatccttttccctgccaagtcaccaatttcttggataatgaaagtattccaatgatcataatatcctatccccatgacatctcatcaccatttgacacagcaaaggtaagccagtacatgagtcatgtacaattttcagcatggtggttacaagatgaaatcttcatcttcctttcaggaaaatatgtaaaactcaagcgaatttattatgggactatctttgaatcacctctaatttatgaaaaattttggaaattttcaatgctctgttttaaacaactaattataaaaccgggttgtgataccatagttgcaaaccactgccctaagatcaatacaatttctcacatactcaactactcatttttagtaccttttttttaaaccttggttcaacgtaaggatcccacttatttgctaggaaattctgatttaatttttaatatcattgtaacgatcttcatttgctgggacatgaaacaatgagtttcatcaaatatgtaatttgatgaagaagtactaaatataatactgagtacctgtccctgaataaaaatgtctattcttcagtggaagaagacacacatttagaaattagaacaactaagttgcaagttgttttagcacagaagaaagtagactccatcagcaaaattgcagtttagaaatcttccctttgactcaactaagtcaatcattttttgaagtcagaaaggcaaactcaaatatggttgtaaagggttgaatatctgtattttaaggaaaaagtaacatgtttttaatcagacttgagtgtcatttcattacaattcccttcctcacttgatagtaactctgattgaaaagatcaatatacatcaatgtgaaatgaaaactagaattttgtataggattttttaaatgtcgaaaaactaaaataagagcaatttcaggatatgaactaagataaacttattatataaaaacagaggtacataatttcagaggcttacctgtgcatcagccagcatgacatctttcagcatgggctggcccttgggctcaccattttccatcctcacataatgcacctgatatcctcttatctggccatgctgtttattgggcacgggtgagcgccatgagactttaacagatgttgagttgacagcctctacctcgactttgcgaggaggaccactaggaactggaacaacatcattggataaaagaaattataggcacttgtcccaccctatcagagcattttctgcattttctttacttaggtttctctttcaaaaaatgggtaaacccactatgttttctttgaagaatacaaacattttcaaccaatgaaaatgcttaaccaatctgctctaccttttaagaaaagatcaaaaaacatgaccgatgcaaaaaaaaaaaaaaaaaatggaagaaaaaaagagtatcagagaaatagaaaaacatgtaaaaaatgtacaaaagccaaggaagatgctttgaggttcaaagcattaaagcacaaagaggtatagcattgaaataataacaaaaactggctgttgattgttgtgtgttttttaaaggtttctttttaaacggcagaataaaaagattcttgattatatgtattatcttctctttttttctcatatcaaagttattccatacaaaagatgccaaaaattcaatgttgagcatcaatgtctctgaaatatgtaagacaaaaaggcaacaaaaaggtaagaaggtagttttgaaaagttaacttcaaaatgtaaaagaagtgactacaaaaagccaagaaaaacacagaagactttagatggaggcacagagacgggctggactgcaagaccataggagccaacagttcttttaaagagaagcaaattactgcattgagattgaaaaaaatgaaaaaaaaaaaaaaaaaaaaaaaaaaaaaaaaggccaggctgtagcaaagacaagtctttggcaaaaatactaaagtaacagcaatgctgggtaaaaagatgagcagagaaaaaagattactgtgagcctattgaaagacagcagatcaagactgtgtcagaagggtgcaaactgacgtagcggaggcaacataccatcttcattggttcgaatcaacacggacaagctctcagggccagggccgacatctgtatgggctgtcacagtgatccggtattcagtccatttttccagctgttccaaaaggtatttggtagtgtccgaaggaattcccaaaatctcgtgaggcttgtcatcttccccatccactgcagtgtacttgatggagtattcagtgataatgccattctgtttttccactggtggaggttgccaacttaccaaaatactagtggaacttgggctggtgcaactaatgtcttgaggaggagctgacggctcttattttggtagtgagttaaaggaggatttaagtgaaaggacaggagtggttgaaaaaaaaaatgataaaacaaaagaaaaggcaaaaataaataaacgaacaataaggacaaaatgaaaataaggctttgaaacttaaattctaatgacaaattatgtaccttggcttagtaatatgaataaaccaaaaagagaattaatgaccaaaaataattgttaaataatgggtagggggaatatgtgaaaatgagacctcgagataatggagcctcaaataaaattacctacctgcgataaaaattcttctaaaccaatccctcagtatctcccacccccactatactgactacccagcttcaaaaaagctgcaaatagtgctagtatttacttgagggtctgatgatgcctcacagatgtttccaagctttcacttctatattctagaatgaggatggtttacatacagtactcatttgtgaaaggcttcttaagtgtgaaaagttgcaataactgctaatgcccttctaccagttccaattaaaaataaataaacaacaaacataagagggttcactctatctgaaaaactgagtttgcctgaccagttttaataataaaaaaaatgttaacattgatcatagcccatatacagtgagcatgcagaatcaataaaggatgaaaatgcagagtccaagatttacctacccgagggtaatgtcaggattgttgattctgactgtaacttgtacttaccctacgtcagctttcagctttttaattataactcttcttgagacaccattgctagtgaagaattagaccccaccagcaaaatttggtaaaatcaataataatcatttatcccttacaaaatgtcaataacacagccattaaaaagaactgtttttttaaaaacccaagtatcaactggaaaagatataatttctgtgcaaaatttctttcattttgtacataattattcatacaatgtagggtttatattagaattagaagacatactttcttactgcccattctaaattaaactagtcactttctgagcaatcattttccatcaaattaaccaagcattatgattttaaaaaattaaaaatcaataaaagacagcacaattactatcattatttaaaacttaataatattatgttcctaaagaaaaacaaacaagtgggcaaagataacacaagtccatacacacacgcatatatttttaaagcaatgtatatggtagactgaataaagcaatcctatatttcatatttgaatgtgtagtctggggatttccctagactttgtgactcttaacattacggagtgccaggtgtatccaattgttcaggggattatcagtctttcttaatgtacgtgccttgtgttcattattacagtccatcaaaataaaagctctctgtactgacaaaaaagaaatcctcataggacagccttgtaaatttggaataagatttgcaaaaccactagaatctcatttttattgattctgactaggggttcttatatctcaaattataaaactattttacatgcattatcattattcataataaattgagttgttcatgtaacagcaaggactcatctgtaattctttttaaaaagctgatttggttttcactagggctatcttcagacctcctattttgtgagaatatattcaacaccatttgaaaattttactttaataaaataaggaatagataagtgtttgatgtgcttataaaaagtctattcaatatgtatgtgtgtgtgtatatatatatatatacacacacacacatatgttaaaaactgaggtttgtaaaccatgggaaatataatattgaagcatgtaacatttctcttaattaaaggcttggtttttagaaattatcttctacaatactatttattagcctgcctggaattcaaagcagacatacagagaacgcattaatttacatgcttacgcctttaaatgaaagaaaattttatgggaataaacgataatcactaatagattaaacatgatcctaatcattttcatgtgaataatcatgctttaaagagggaaaaacataaattttattatcaaaaaaccctgaaagttttcaagtttctatagaaaatgaaatggtggaaaacttgcttatttgtatggaaggaaatgaatcttttaaatcacaaatttcatgtttgctgataggtctaaatatgaggttaacagagcatcttcttgacaaaattcaatgtatttctactacagatatctattgtataattcactatgtcaaaaagtaaagacaaaatatcacacaaagaaatctaagaaaataactcaacaaaactcttcaattcaaggtaaatagtattttttatgaatgaactgtaaacacatactaataaaaagcaattaataataataagccaccaaactttccaccaaaaacaaaatcctgtataatactttatgcaaaacaatctgccctgggaacaattaacccccattgtgataaacacagctatgcttaagggtaacagctccaaaaagaaattgaaccccaggaaacaaaatacaatttagaattgcaaatatgtttgcgattattccattgtttcttaatttgtccacatacagattttctgtcaatgttccaaatttccacaggtactacacacagagttaataagaaacaagtcatcagagctgagcttttcttagtagaaacaaatacatgaaataaggacttgtttgattgcaaagctaaagcctgtgtgcttaaaaaaataaagtttttttttgtcttttgcagcctctttcatttgcgaagccctcctatgattattttacagggttctcaatgtgaattttgctttaaagacttgtaattcattaaacagggcttgatctaactcctttaacccacatttcacccatggacgtctactaccttctttaaaagtctttcagtgtaggaagtgggaaggtgggatctgttatttggatcaagtgatgagaccaaaagaagtcacagttacactttcacctgtgaagtgtgatgcatactaacctagagactaactattaagcatattagcaggtttgcttattggtgaaggtgaaagctagcaacatctccccgaggaaataaaaaggcagaaagtaagcaaagagagacacctacttgactgcatggttctagctgatatttctgcagtagaagcacccaggccttgaggggagcgtgcagccagacggaaatagtataagctgtttggtttcagtccttgcagcctatatgatgtccctggctcaatggtaattcgttgctggaagcaataagagaatgtggtcatcttcattaaggttcatgcaaatactttttaatcatactgtctggaccatcagatttctatcatcaggattataatctcatcaaaatatcaccaaaagagtcaatagtgagtatccagggctatactaaggaaattatataatgaaaatatcagtttaaaaggcaagtttctacaaaggtaactggaataagggaagtcagagatctttttaatgttgacacagtcagccaaatacatcagataagacgaagattgagaggccaacacccatgagtatgttctgccgttaaatgtgtgtatgttgctgtgacacagatcacaatagaaaatgacacctgcccctggtagtggaatctgcccaacatgtgcaattttaattgaacagatgtctactcatctcccatgaccttctgaaatctcaattggaggcaaagaaaacatgaccagaagtagcaacagtaaccagtatacaatttacaggaggttgctataaaagagatttgaaattgccaagttttaatgggtaaaatatcacgttagtcactaaagaaagttgaataatttatctgaaaccacattactaccctaggttgatctaaaataactgaaaaccttactttctttgtgaataaagaacccacagccagaaaaaaaatagattcacaaatgtttgtggacttttgatatacgatttcgttaatcaaatgctataactctcaccttccgtgcttaaaatttgtcatttagcaaaaatataagtgtctatgggtaatcaatcttgaacatcagcctgcagtaaaccttaaaatgcaagtgaatacataatctagtaatggtgtgtgtaatcttaacactttatcaaatagtgtttgctattcacacaaacaaatcagttaagaagaattcaaggccgggcacggtggctcacgcctgtaatcccaccactttgggaggccaaggcgggcggaacatgaggtcaggagatcgagaccatcctggctaacatggtgaaatcccatctctcctaaaaatacaaaaaattagccgggtgtggtggtgggcgcctgtggtcccagctacttgggaggctgaggcaggaggatggcgtgaacccaggaggcagagcttgcagtgagcagagatcgcgccactgcactccagtctaggcgacagagtgaggagactctgtctcaaaaaaaaaaaaaaaaaaaaagaagaagaagaagaagaaaaattcaaatataaaactagagaaaccatccctagggtgttctgacttacaaatacaaaagttttcaggaattttagatccaccaagtaagaaataaagaaattccctaaataagcaattgtggagcacagtagctatgccaacatttaagcatcacaattctcctttactctttgtatatatgtatgtttgtgtctatgtatgcctgtattttagtttggtggtcgtgatgaaggtttaaacaattcagtgctgatttacaccttacagaaaacaccaatagctcaagttgtaccatgaaaactttaagtcatatctgcatttcaactatataactttttgagtgcttgatttatattggctttgttagctaaatctaaaaccactgcatttaaaacctattcttttgagattctgctcaattcaaacagatggaataaaacagaagtttacaagaacatattaatttattataacatccaaaattatgtactacaagttaattgagagtagttcatttagcatgtgagttttttaaaagatattctttattagaacacagggactgtttcactttgtgaagatttttttttcagataaaaaatgctaagaggcataataaaatgaatatatgtgtgaagttctcaaacacagtgccattaactccttttgtcctaatgttccccattggatttaacaataataaaagaaacatacttactactattatgtattctcattctgaaaatgttagatgtatcttaatatcgatttctatcatgtattcaaactgcactcaagaagcagtagaccctaaccgttaacaacacagactctggaactcgactgcctagactcaaatcccagctctgccatccactagtgcgagactttgagcaaattatttaactttttttccatgcctccattttattatacgtcaaatcgattaataagaaaggctagctccagtgctactataaaaattacatgcattattgatggtgaaacccttagaacagtgcccattaatgagttaattatattgattttcatttctcttttcagtgacgatcaacaattgccatgccttctacaatctgttatttcatttgcacagcatactcaaatgttatacacactcaccttcataccaaatactttttagcaaacaaacatttgctattggggaatctttgaaaccagggtggaaaaattcatctagccaaggactttcattaacatatagagctaatttagtcacctgtccccacagtgacttaaatactttcatgaagaagagaaagtcctcaagtctcattgagtatttattcttccataacctgatacatctatggaacttggaactctgtcagaagcacattccaacaggaacaagagttattttgttttgtttttccccaaagcctccaaataaccactgttttttgtcattgttgttgttttggggtttttcttgggggggagggggagtcaagttcctcttttaattagtaaatcttttccatcaaggtcctcaatagctctctgaccaagaatgtggataaatacacaaaaataaaaaagtggccccacgtaatgaataattcccaaggtgagaagcactatagtcttacctcctctccatgctccccatctttgtagaccagttcatagttggcaatggtatctgaacgtggaggtgtccaagagagcaaaatacttgtttcagactcaggttctgctttgaagtttagtggctgccctggtactaaaaacagggaggcaatggattgaactcacaatcaccaggagtattcacaaagttcttccattagcgtaacctgcttaaacctttcgaaatctgtacacatgtaccagcttagtggaaaacaagctcctttaccttgtccaagttaacctctttgtgtacagggcaagtacaatgttataaatcctgctctggagtagtagaacatctacacaagatatagtagaactaataagtataaagtatatcggcctctgaattcaattttaaggaaaaaattctttacttcatgatatggttgttagtaataaataatataatttacataaagcacttgaaatattgccaaaagcataataagtacaaaatacctaaaagtattgttatttacaactgagtaggaacttactctctagcactacatgtaacattcaaaattatttccaattaaatttatgaaatcctacctttacgccaataacaaaacctaacaggcaaacagaatcactcagcattttttcttaccagcccacattttgaagaagaggtgtaagaaaggaaaaacaaaacaaaacaaaactctatcacttacaaataatgacttctaatctctaaactatgttaaattatttaaagaactacacctaatacaaacaaaatatcctctctagtgccacaaagctaaactactacaaaaattaagaagtttataggatacacttatcagaaatatggtaacttaaagagatcatctataattctcatgttagccatgtcatctattcaacagacaatttggaagagctgtttatcagctgtaacaaagaatggaaagtctattcagtttaaaacaccttactcaaatgaactagaataattagtaacctaaactttctagtccacacctaagcctatcagttcccctctatccattatacacaaggctgagtcagggtgtcgctggcacatctaatcgtacattgttcttggccactgtctgctctgattggtgagtgcctatgctttcccaattgtaaaacattttgatcattacccttgatattatggcatgtctcaatgtgctgtggctgaacatatgttcatattccctcaagtttaaataagaattccatttatatttaaagaaaaaaagagaacaataatacttcatagcagaggagtaaaaaaacatctaaagtgtgctttaaaacatctaaagtggcaacctcagcaaaaatatttaaaaatacatataatacagtataatttgtagttcaaaagaagcctttggagaaaatgtattgctttccttttcttttatagttatgtctgtgtactatggctttaaaaaatgccctttgttaaagcagtctgcaagaatgatttgtagaattcctaatgataattttattcctctggtaagtcagcctgtgtatatatatgtgtgtgtgtgtgtctgtgtgtgtgtgtgtgtgtgtgtgtgtgtgtgtgtaaaggaatatatgtttggactgatgcttaaggtcacaaataatcagtgcttcatatttctagttgccttcatcatcttttctctctctctttttaaaaatcacaggccttgagagtctcattgatttgatgcctctgggagcttaccttctgaacagagtatcacatttttttccccagtacctgcccagtgggtgacctaacacaatcatttagattgaaaggtggaagcgaaagaagataaaagattgagaagcaagaggcagagggacagaggggaacaaaacacaaataggcaaactgcaaagcaaatggaaaatgcattatttctaaaagggaaataccaaaagcactggcaggagcaataatggaaacaagagtgaccagatagatgggaaaattatgataggacctaacctaatattcacatgataaaagggtttctcaggctaaaaatgcacacatatgcctatgtatgcagtcactgatttttttcctagttttatttgcttctttctttctcccaatttcctgggaaacaagaaagtttgtgttaactcctgactcaaaccaaaccggactacagtatggtcaagaattagaaacacagacaacactgaagggctgctctcgggataataattgcttgttacgcatttcttccctgcctaatgctaataataaattgacattgattgaaaacatcttggaaacctaattaactttttcttacttaaactgtttactttttgcttttaatttgtcttgagtaaattcccggttggtctcaatatttcattcttgtttagtgacacaagctttgtctgatcatctaattctgcttgtttctattaagagccccttccttctaaataatgacttaagtaggcacatccaagtctcagagagtacactgtcctttttattcttgcacaaagctaaaggttggctagacgacttgatgcaaagtgtcttcatctaatgtacagggggttctctcctgttctttccttatccttcttttgaaatggttcggaggttaacttcatttattagattttaaacttgtggttcaggcttaggcatggtaactcacatctgtaaccccagcactttgggaggccaagttgggaggatggcttgaagtcaggggttcgagaccagcccaggcaacatagcaaaaccctgtctctacaaaataataaaacttaaaaaaatcagctgggcatggtggagcatgcctgtagtcccagctgcttgggaggctgaggtgagaggatcacttgagtccaggagcgtgaggctacagtgaacgatgactgagccactgcacaccaccctggatgacagagtgagaccctgtctctaaaaataaataaataaataataatatataaaataaacatgtggtgcgaatacaaatgctcagaggtgtcaggtaatttagatgagtgagaaggccatatggggcctggggcccggtggagagtgcccaccacctgaagagggaccgcaggccatgctcagtgacagcaggttgctgccttgtgaaatgtgggcgcactcttgtcccagcttccgatttccttcacagaagttgatcatgaaccttccaggtaaaacctttccattcttaattactaaaaattaattgaattttaaaagcactgtatggggcaaaatgtgtctacaggctagattcagcatatgggccatgaaataaactttcatgatctcaggctccaggctcatcaatggcttaagagtgcactacccacacttcctcgggaactgagggtgtacctaacgatatcacttcctcagggcattttgtcatatttgaatccacaaccatgaagctgaggacacaaaggaatttttttaaataaggtataaaatgaatgtatttttaaattcccaacatattggtcctaatgagcataatatatgtatataagaaaacactttgttttctctggaacacttgagacatgggactactttcattatctgtctattgaatttttataccaaatattgggtctacagaggttccatttcacatttctattaatgttttctctctatatatgtatttatacatataaatgtataaacgtaaatatttacctacattttatttatatatttatttagttttgagacaaggtcttactctatcacccaggctggagtgcaatggcacaatcatggttcactacagctttgacctccaggtctcaagtgctccttccacctcagccccctgagtagctgagagtacaggtgtgtgccataacacccggctaattttttaatgttttttgtacagacagggtctcaatatgttgcaccaggttgtctgaacttcctgggctcaagaaatccttccacctcgaccactcaaagcactgagagtatgggtgtgagccactgtgcctcgccttcttacacacagatattttatgctcttgtaatcactacacatcacggtttctcactggtatttttttttttaaccttcacttaccagtcctttgtctatgtatatcttattttatttttattttattcaagagtttttctgtgttgtaacatttccttcactgattaactgaacataaattttataagaaaatgtgagattctgggaaaatcatgggcaaataaaaacaacatatccagacctttaagcagttacttcatattcaaaggagagatatgatattgaccataaaccagatttacaataggacatggaaagcaaaaataaaagaagcaaaaatttttctttaatattatatttaagaagtcattatatactgtaaaagtatgtccgccctcttgattacttacttaatgtccacaaggaaatagaaatgtgagctatcgagtccctaaaatgagatcataatcctactgatacatgttaagtacttgagtattactataattacactctatataaatatgtgaaagcaactccaagacaagggatgaaaaagactaacaagagaaaccttcacattatcagatgctgatatattagaagagattaatatttgaataaaatgtagagattatctctaaagaaaggttgacacatattgcactgctaaacaacagtttcatcttgctatagtataaatatgaaatatgaccaaagatactagaaaacccatgattgctaaaatatccagtattttattaaggtacatgttttaaaatgtgtgtatctagcatattgataaatgataatgacaataaaaccgacagccagaattataacggtagtaaaacaaagcaaaattcaaaacaaagagtctgatgtgtaaatgccacaaatatatcattgacaaaataagtacttaatacacaagcatcagcacaaatcttattctcaacagtcattaaatataaatgagaaaaagttaaattttattatagttgtatttatatccagtgctcctttactcattgctaaatctattcagaaaaagcatttaaattggactcataactttggttattagaaagcagtctttttctagtttgcttgtataggcctgttgacatacactaatgaaatgatttataaacttctggaaacctaacagactttgtctctcaatgtcatagcttatattttaacacttttgcaatgcccagaatttgtaatagcattaacatccctaaaatgtttaaagttgatactagtcattagtatttgataaatatatataattctttatcttttgaaggcatatactgttaaaggtatatccatataagtcagatgattttcaagaatctattaaatgaatagatgtaattagaggtcagacatgctttctaaatacagttcagaaaaaagacacatattaggatttaagatttataatgcctctaattagcatgaacatcaagcaacatttaatgcattaggtttgagatttaacttactacttctttgtcagagttttatttctacttcttctataaaatatagttaccctatgcttttggtacaattacctttacaagaaaactataggaggtccttttttccttcctgaatgtgttttctaataatgaaaatatttttctagcttaatataaatactttccttgtcaatggccatatattccccatattttcaaggtaaactagttgcaagtgactttgtaatgccagaagttagagctatggagaactgagaagattgacccatatttcagaaaataatcatctcaatgaaagtcttttcatatttaaaaccatttaaagattactcaacacggtcaactgtactaatgttcacaatcaaggagaaaaactctctgactgtaaaacagacagatcatattctcattttctgtattaccagaaatacacaaatttacatcaatccttcacttatgtccatctgtgtgactcatattagatcaaatcaaaagtgagacttctctcttaaactcactttgatcctaaatactgttcttttggaatccggtttcaaacaaaaacaggaatgtgaatgtcacagaatgaaagataataaaattaaatgagtaccttttagacacagaagacatcaaaatgtacatttctgtgtatttgtatttaaaatgtacttcaattcctacatattattgatcagtaaatttttatagggttagaggagaaaaattgcagtgaaaataatcatatccttaaattttatatctcataatggttatcgtcctagcaatcatcctaagaattctttagtcagtaactttcttgttactcctttttcttaaggagcagctcggcattaattacatcagaacaaacatcattgtttttggtaggtgtccactaatatccactggcctttttaattaagcctatagaacagatcaaatcattgtgctattttggaaggttttcttagcttattgagcttggcaggcagtcattacatcactatatatcttctcaatcaacatgtattaaaagtaaaactattatggaagattcttggaaacatcttcatgcaaaaaagtcagttaaacagagtgggaataactattctaatatatccatgtcccattcatctagattttctgagttctgtcattaaattaaatcagagcttttgaaagtagagtccccagctcacagtaactcagttgcccctctgataatgctaccttcactgagttatgattcaatgtcatattctgtccactggtcatataaaaaaataaagatatggtctgtctacttcaacattacttctatatttttcaatagattacgactgaaggcatcagggtttttcatttagcattctaaatacaaggattctcacaattgtctaagattcacattttggttggattaggtttaggaaaaattttgtttctcagataatcttcctaccatcagaaaataaaaatatgaaacactatagatttctatgtttaaactggtgcttataaaacttagagccaaatttatttaaatttagttaaatttcagccagatttactgcttgagtgtaacgatctttcataaaaatgttcttccttccacttcttttagataaacttagtttttttttttttttccatttctaaatgttttcatgtacttctgcactggaataatctaatagctacctcagtgtttcagaagtaagttatgtataattcttagataaatatatgaataaatgaaacaattgcgtttttctctcttgcctcttttcattattgaatacctacactggcataaaaacacaaaaactatcacattaagcaaattattaatttaaaaggtaatggtagttgataatgattaggctctgcgtccccacccaaatctcttctcaaactgtaatccccatgtgtcaaagaagggacctggtgggaggtgattgaacaatgggggtggtttctcctatgccgttgtcgtgatagtgagtgaattctcacgagatctaatggttttataaggggctcttccccctttgctcttctctctcctgccaccatgtggagaaggtccttgcttccccttcaccttctgccatgactctaagtttcctgaactctccctagccatgtgaaattgtgagtcgattaaacctctttcctttgtaaattactcagtcatgggtatctctttatagcagtgtgaaaatggactaacacagcagttaaaagtatccagaatccctggatttaaattctgcttttgcacttagtaaccttacgacctacggcaagtttctgaatcacgttttatcctctttgatcttcaatttactcattggcaagtgggataattccacatctgcctaattggtttgtgagaataaatacatgcaaagttcatagtatagtgtcctccatatgttagctactattatgatgattacatattaataatttaatgttttacatattaagttacaaaatgtttccctccattatctaatctataccctgttatgaattttattgcatcccacaaaaatccatatgttgacatcctcatccccagtacctcagagcataaccttatttcaatataggatctttgcaatggaattagttaagatgaggccataagagtgaccccaagtccgttatgactgtgtactagtgaaaagggaaatttgggcataggcatgcttttgggaagaacataatgtaaagatgaaggtagtgatcagatgatgcttctacatgtcatggtacagcaaagattgccagcaaaccaaccaacagaagttagggcagcagcattaagtatatttccctcacagccttcaaaaggaaccaatcctgccaacaccttgatctcagactccctaggccccagaactgtgagacaatagattcccgttgtttaagccacctagtatgtggttcttttttacaggagcactagaaaacaaatagaaccactacactctataaggtggttattattatagactagaaaactgaagttcagagagagatgacataaatcacctaaggtgacagctaataaacgaaagcttgggcttcaaaccctggttatgttactccaagaccagggattgaaaaaataatcacagctgagaaatttaaaaagctcaaagtggaatgtaagttcccatataatttcttagaattttttaattgttatgtagctgctaaaacagtataataaaaagcaatctcataatagttaaccacttttagtcaagaaaaagcaaaacaagatttacggatgtctacatttcccaatgagaagcttttttggtaagaacagcctacagtattttttttctgcatattactacagcaaataaatacagaagtactgcaaatggcacacagagaagatatatggatagtttttaatacaactgtggtgagacatatttttatagctggctttcctacaatgtcatagagaaaagagtaaatccatgaacaagccaataagaaccaaataatggtatgaaaataaaggcaggcgaactattaatataaatgtgctctgagattcctagaagcaaggacaaatagttaaacatacttcatataaagaccatgccatgaaaacaagtcagtgattcacaggtatcagtgaaatagatgataggtacattatctagtactggcatctgagaaaatttattaattcattgccaggattagcaatgagttatgtctacagattatactgtctccaataatatgattattatgtagatttcaaaacaagccaacagcatgatgccaaaacattcgtagattaatgcaggtttaaaagatgccaacacaataaggagtcaaagaagtagctctcagatgctcaagaataaactttttttttttttttttttttttttgagatggagtcttgctgtcacccaggctggagtgtagtggtacaatcttagctcactgcaaacttgcaaactccatctcccaggttcaagtgattctcctgcctcagcctcctgagtagcaggaattacaggtgcctgctaccatgcccagctaatttttgtatttttaatagagatgaggttttgccattggccaggctggtctcaaagtcctgaccctcaagtgatccacctacctcccaaaagtgttgggattacaggcgtgagccactgtgcgtggctcaagaataaactttagaagaggcctgttattttatattagcccaaagccaaactgatcaccttgactcaaagaccaaagaggtttgataacctcttagaaaaataaaaccactgggagggccaagttttccttcataaaatagtctaatgtctgctgtagctcttagcaaagttaatcaatcaggcccaatgttctatctgagatctcggtaactgtctctctttatccactgaggccatacagagaaaaacagaaattaaagccactcagagaatacttattttcaagccagtagcttctggcaaatataagccatttaaatacccaaggccctgtaacagttttattttttagctttgtcttgaaccatccaatcttacacaaattaaatactcttttgagaccactctaccatactagctattacaaagaagtgtcgtttttctattctcaaaactgggcatgggggagacattgttctatctcacatagagaagtcttcaagtcattcccatacaaattaaaaagaaggggtgttaatgcattgttctgctcaaaatgattagtttttcagatgtccatgcttgttccttttcagatatctatcatctgttgctttgaagccctaaatctcaaaaattaaaattcataccatctttgttccttctttgtttttgtccttctcacctctttgcaccagcccttccctcctgccctatttccctcctcaaccaaacttacctcctgtctgagtgatgacttgtatgtcacttgaaaggggaccatctccaattgaggtaaaagccaggactttgacagaatatgttttctggggcactaagttgccaatagtagtgatttggctgtcagctacattgtgtttcatccagttgttgacatgttgagtgggatccattgtataataaactctatatccttggatctgtccatttggctcttcaggttccttccactgtaccaaaatggtggtcgaactcaacattcgtgcctggacatccctcggggcactggatggtgcttgctctgaggtttgtgttagcacaggttcgctgggaggcccccgcccaatgttattgacagcaacaaccctgaattcataatccgagtagggacttagtccagcgacactgtagcgtgtggtcgccaccccatcaatttctttgtaaagttcctcagagtttttaggtttatgctgaattatgtaataagaaacaggctcagggttcccagagtcccacgtcagtgtgatgcttgtagctgtgctctcggtcactacaggagttcctggaggtttgggtaaggcttggatgggggaagataaaagacaatgactacccatcatccctataatatttcaaaaatctataaactctactatgaaaatgacaggattatgtatctactgaagatttaattaaatgaaattatagcaaagagtagttttctgaatggccaagaaggacaggaaaacattcataggtgacacaaatcctgctttcctagaagggcttgatagcatatttttaggcttgtatccaaatcctctacttattagctaagtgatcctgcacgcatttcttaacctctctttgctttagtttcctcatgtggaaatgggaaaaatattattatttaagtcatattatacagctgtatgtaactgtatttcatgggtttgctgtgaagactaatgagccaatccactaagattcttagaatgtaactggaacccacaaaaaaaccttagtattagctgcagttattactattattataccaaaagcttggccaattagccccttgccccaataaataaatggtataactgaaataccgataaacattgaaaagaacaaaatgtggaatacattgaaatgaaattaaattgcgatgaaacaataacatctatattctggtaagacacaataccattactaaaaattttcttgtaaatgaaaaaccaaaaattttaaggtgcaaaagaatagaaatttcaaatcaatgctttattcttaatatttaaaaattgctgaaggaagtaaattaaggcacattcaccaatcactttttaaggtatgttatggtcatattaatatgcattctatattccacatcagaaatatccaatgtagctacatgacaaatatttgcaataaaatccatctttttagaggtctaattctttctttttagcagaagaatacaaatcaaaatactactaattaaaaatataaactgtctgctttgctgacctcatattcaagtgccttattctaaacaatgattctgaaacgcagtgctattagggtaggaaggggcattctaatagttgactctttagagaaatctcaaagggtaacattcatataatcagcccattagtgtccctgtttccttgccaacataaaggcaagaagtataacaccccctagaatggcagcttttcaagagcagcaaacttgtacttctgacttactgtaaaattgtgaatgcctagaatgctgcctggcactcggtaggtttttaatgagaatcgttaaacagttaactgaataaatgagtcagcacccattcacctcattctcttcaacctgttcttttgttttgatttattttaatttgccattaagattcactcttatgttttatttgtttatttttgaggtggaaaagacagggaagtggcaagagtcaggaaaacaaagatgagaaggtgaacaaaatattagtttaaagtggcccctgcttttgaattcttaaaggtcttcagcaagccttcaaatatttaaagctgaaatggtaattataaaaaaggtgattcaatatttacacactactcaaagaactacagaatgatagtattttgtcaagggaatttactgaaaataataataaaatgaaatttgtttaaatattctgacctggcatttttcaaggctgtgtgtgctccagatttcccctacatgtctttctgaactttcaaagcaaatacaaatattgctaattaaagctgtgctcactgatatttagctgacattattagtttcactaagtcacatttattgtacagtacaggttttatgtctgtaatgtacggataaatacatgtgtgcttattatattaaggttacacaatataacattatttcacgattgtaaatgttgacaatgtgtacctttgttctcatgtcattagttttatatagcatatatttgatatatacgcttggttagagatgcgataccaattataacgtgtattgcattttctaagatcaccccctagaatggcagcttttcaagagtagcaaacttgtacttcttacttgctgctgaattccaaatgcctacaacattgcctaggaaaagaagataatttgtgttcattttgcaatagttctagccatctgcagaaaacttaagttgccctatgtctgactcaatttgcaaacactttctagaattctataaacactaggggaaaaaaaaacggtacccttacatgcttgtactctttctctttagttcaaaaatattcatgtaatatagtactttggttatatttagtctgttttttaaaggaaagaatattccttgagcactcatctatgcaaggtgaaagataaaactacaacagaatatactcttacttgccttttgatttttaatagtagggctcaccaaaaagttaaatcatctattactagactatgttgatttcaactttttttttcttctttttcctttgtatttagaaattttaagcatttattaatgctcatattgacttttcttggggttcttatcaaggttctggtctagtatgtagactgtacacatcagtcccaccataatggtcgaccatgtgtaaaattcctagttctgtctggttagtgcctgggcctccatggactgtcttttaatattctgatgattatctctacataggctgccagatacttccaagaaaaaatccgcctatctaggcttatgcatgttatataataccacagatatgattaggttatacacacatttaaaatgctgaataatgaattattttagattttcaaggatgggctttctagaggcattagtcacttggcttgagtgtacccagatcctcaaagcataatccattgagcatacctttgacagtgatctgtgctattgcttcaatgacacccagtgttgacatagcaacacaggtgtaatttgctgactgtcttacatcattcagttctagcacatttcttcctattggcatatcatcttcaggtgtcagatcttctgcccccaacatccactttacataaggcattggtgaccccacggccacacaggtgatattaacgcttccgcctggcatgatttcatgattagtgggtgggatagagaatcttggtgggacacggcgaactggaacaaaacacaagggaaatgataacatatacaaggcaagaaaaagtggattattaaacacatgacatgcaccgtacagacacgattcaacaattgaaacattgtggattgtccaaaaacaaaacataaagaaaaactgtggataatacagaccatacaagtatggtgtgtgtatacacagaattatttatttagtttagtcattgatatcttagacacactaatacaaaagttgattcagacctacaagggccccacaaaaaactatctacaaactaacaatacacaaacatcatgcataagataaacacaaaaacatatacatgcaggcatataacaatgattctatgcaggcatgtatatgcagaaaagggggctggaaggtcaccagcatgtttaagttgagtatcaaaaccaacttcagtgctgtgcacttccagttgatgtgaatgtaggtgtgggaccacactgtcacatcccagccctggaaaacatcacctagagtacactgaaagtgcactttatgttttcagattcatagtggatgcagcctcaagacctcacactaacactggaacaaacacagaaatgtatatacatattgatttacagtcacagaagaagaaacaggctaacaccagtagagatactggattgggtcatgcaaggcatgcacaagatggaatctcaaggcccgtgctaaggatattgaaagaatggctggaatccaagacagcaatgaccgcagaagaaataagggggcaatagaaataaacgtgaaagggggaggtaaagtataacgattgaaacacagggacttaggggatgacagggttgaaagacagaagattaagctcaagttgttaaaggtaaggattgcaaattcagaaagggagctgggtgtttcacatacaggattccattcaattcatatcaaaggtaaaacaacataaatgacaacaaaatcttttaaaaggctttttatgcccacattcaaattgagggacactggatctaaaacatacagcaggacatgacattaagagaagagatcatattaaagcaacataacacagaaaaattaccaagcaatttcagttcagtgttcctgcttcagataatctgcaggtttatgtgtgtttaagtaaatgtgttttggatgtgatacaaggagaaagtgaaagataaattggtttcatctggggcttttactggcaaaatgtcataccataagaatttgagatctagagggtaatctttagggagcacaccttaaatacatttaataaagattttttaaaaattataaataaactgataagtaacctcataaccccaagaagaagataagtaattctgtctgaaaactttttggctgctcttaaggtcgagataaacctccgcttatttgagatggctcactgcaatggcctcatgggtgaatgacagtcataggagaagaagagaaagctaagcatgcctcctgcagccaattcacagaggttacacaaagcaagcaggagccagtgtagactctgaggtatcaaagaacatatcaagaaaaatggaggagagtttagtcttcatgcttgggattaggggagaaactagaaaaagtcattctatgggcagcaggcatccttataagacagaaattaaaggcagggtgggagatggggacagtggagcaggaaggaaagcaggaacactgaccaagttcactggaccttacagagttaagtgttaccagttaccatgcacccaggtacattctctcccaccatgcaccacagttagataccaccagcaagcaccagaagccatggccagggcattctctgctaaaacataccattaaccaaaagaagaacacaatgcagctacattcatttcatttgtattctttgttattggtttaattaatagttttgtaaggtgggtaaaaagtaaaaaacacaccaaccttctcgcagctctgagggatgtagggggtttgatgcagaacacaatgaaatgaggaaaggagaaaaacaagggaaacacagagagagtaaaaaggccatatcaaggctttcaactgctacttgaacatctttattcgctctagttcatccttcctatctcagctggaaaagttagcaatatctcacagactaacatggtattagaaacaatagctagcatcattttgaaattttccatggaagaaggtacacatgcctcatgcagcaagggaggtcactattgtggaaaaaggatcaagggactttcgaagaatttagagaagaaatgactttcttcatatttccccaccccagactccataaaaaaagaaaggagagaaaaacatccccagggaaacaaaattacctctaacaaaaatttcaaaatcaagctaggtattttcttaagggaacccatcctattgtaacttaaagccctctcagtcttttctttaatcccacccccacccatgcctttgtggttattcacagatatgtagaccaggaataagaacacttccactggataaaaaaaactacaggaactggctttgagaactctcgggaagaggaagtacttctttctagttgaatggaaaggcatagccattcataagctcacagtttaatcatttctattacttcatgagaacatatgaatgtatcctcataattcattcttgtctcaaggacaactcacattactatttaaaatacagttttccattgcaatcaaaaaactaaatgtttcggtaagtcttaataattcaaacaaaaaggtgtacatatgtgcacatatatgaatacacatgtatatataatactatgtgtttataattaagaaagtatacgaagacagaaatgcaactgtgctatttgcatgtagcacttgttttatagagttagcagctttatccttacagtttcagcagcaggggtcatgaagacataaacacctttatgcttggaattgcacagagaactgattagtagcacaccaagcaattatttcaggggtttaataaggaaacagaagagaaacaacagaaaaaaagagaaagaaaaagaagaaaacctcaaacaaatgcaaagcacagttcaatcaatacagtaaaaatagaaaccaagatgtaaaaatgcaaatatacttacaaactccaagcctcaggacagattatactcaagagttgtcttttggagttaaacaacacattttaaatttttaacttttctatttactaacatgtttcagctacggtcactattaccaaaccagcttgttaactactaatataacaacacggaccctgcggcgtctcaactccccctgagcctgaatgaagaagcgatgccagggttatgtcattcctacctctgacatataaattggcaggagcggaatagcgagtgcccgcgctgttggtggcaacacactcatattttccttggtcagactcttcactctgctcaatctgaagggctcctgtatggatataaaatatattgccaaagagatgatcagagaaggctttctcagttcagaaagctaaacctcttaacaatatgaaaagccctgcaaagcgaaggtccactcaacgtcgattcaatctcttgctaagttgcacagacagaaaatgatgcgatgagaaaaacatatagagattattttttttttttacatcatcaatgctagcattagaaatcaatatctcttttcccaagcaagacttctagtcataattaacactcttatttcctagactaataaaatgaagatgggtgagactgcttcaaggaagtatggcttttaaataaaacaaaagattaatttttggttttgttttgtttcatttgggtaccaaaagtggcgcaaaagataggtacgctcaaaaaaaaccaggctgggttttcaagaaagtcttctgctgaagagagccaaaaatacgcagcgagcacaaaaaggctgcacaaagcaaaaaattaaaattagtcattataaattatcaaaatatcacttaaagaaacaaaactcccttaagacatgcagatttttaagaaaagaaagacagttttccacgacttacaatcatttattacgtttgctgaaaaacaaagagcagttgaattagaagatttttaaaaagttaaaaggcatggcctgtgccacaaggaagagccaaccaaccactgcttgaggaccctgagatggatcccctaagacacccatcaaaatccaccagtgggattagcagtgtggtgtcacaaaaccccaagaaaaatacaaaacaagaattacaaaagaaatgcacactgagtcgaagtatgaaaaaccagcaataccacataccaccaagaatactgagcaccttttgtttccatagcctgaaggacagaagatccaaaaatccggagacgagtaatccaagaaaaaaagaagtggggaaaaaagcattgctgtcagattgtagacgagtgggatcaggtggaaaggggagtcattctttgacttttaagacattaagagaaaaaagaattgaagaacaaaagcaaaaaccttttgaaagataaagacaaaaagcagatgctccagggtgtcttctgcatgtctgccactgttctccagaccaccttggctttggtccagaacaagaacagctaaggaagaaaaaaaatgatctttttttttctccggttggacaaaaaaaaaggaaaaagaagaaaaaaaaaaagaaaaaggaaaaaggaagaagaagaaaaggaaaaaaaaagagggacagatggtacgctgtgactggtctgtggtctaaagacctggatatgctttctttgaagcatatcacaacttaaataatcattttcataaagaaagaaatgaacaaaacaaagagagaaagaaaaaggaaaggaaagttcacaatatgagagtcactgatcataaccaaacagtacaaagaaaaaaaaaaagttgatggacattattggaatgacgctgaaaacaggacaaagatgagagggatgaaaggacagaaagaatgagtaagatcattctgtgaacgttagttcagcactcttacctcttattggtgtaccacctgggtggataatatgaatgcaaataagattagaaagaagaagcattagtacgagaagaaggaggctagggctggggagaagaattaaattagatttacagaattaaataaggtcttaaaagaaacttgaattactatattggtaaaacaggaatatattagatagtattattagatcataaaaaacaagttgcattataccacagagggtaaagaccgcaataggcagcattgcctttctcagagaagcaactgagttttcaggtctggggtcatatagggttagaattatatcttatatgcctcatatctcttaaaaaaaaactatacaatatttttaaagacatagtttaggaaaatactggctaatctatttaagtatatatatagatatgcatatatatatatactgtgataggaaacactaaagactaactggaaacaaacattgttgattggatatcttatactacttgctatgctacattggtgtgccataacttgtgtactatttaatttttctgcacagtgttcttacgataacagttctgtggaggtgtgtgtgggagccactacagagatctggtgtctacactgacagttagtaaaatgcatgccatgcattttattaataataataataatattctggatatggaaattagtggggttgaagtgcgcttcagaactaagcacttaccaatagattctggagatttaaatacggagagaagaaagacagcataaaaatattattatattccttataatttggtacaaatttttcagagttaaagctttatatactaaatcatctatgttacatgtgaataattaattcttcatttacaataacagaatgctaatctacacaattctgctgacaacaagcaaaagaggcagttaacaagacgctttaacatcacaggacaggtcaaaagctgagaattctgggaagacaggcagttaaacaacttagaattctataccaatattactaccaatgtcaaagtaaacagcttattattatatatccctgtgaaattacctagggacaggctctaaaacttaagaaatttagaattatctctacttttaatctaagagagcaaaggcataaacttgggatgggaatgggaaaaggagaaaagggtaaagagagagagaaaacagcaaaagctggagtctacaccaaaagcagacttctgtagatccagtcactggagggttcaaaaaccttgacgggcgcacactactgtggctaatgtgtagaaaatgttcactcacaatgttattatcatagtattaataaaaatcccctccttttactggtattttctaaagacttttaaaaacatacatctggttactcatgagataacgtttctgtgtttttatgtattagtgaaaagaaagcagatgtgcccagacttactaaactttggtactttgatgagttcaaatgtagaaaagatagcagaaaacatactttaataaaattgaaacattttagggtttaatatgaacattttattttttaatggatacaaccattggatctccttgcaagttctgaatgaagtccaatgttgaaataaatttgtttcaaaagaaaacagagaaagaagaaagaaagaggagaaaatggatccatcaaatactgcgaaaaagcagtaaattaaaaaattaccaaaaatacagtcacagcagtgagcaatgtggattaaacagaagctgcaaaacacacagagaaaaggagaaagacagactctgaaacaggctatgacatcacaaacatggaccacccattaagtaacagagaaagagaagagggagaaaaatcagtacctagaaataaaaaataaattaaaattaaaaataaggagagagaaaaattaaaaaaaaaaattctctaggagttagtagaaacagtaacaagaccctacctgatcgtaactgcttaatacgaccattgttgttgcttgtgtccacaggtaagaaatctttaaaccaagtgatttctggatccggattaccactggctgcacaaagcatggtggccgtgcgagtacgctcaaccaccttcaactgtgggcccatgtcaatggtagggaagcccctgggaatttgatcttctgcaagacaaaaggtgatagaaacattcagttaataagtcagatgctccaaattcaagagattccccagaaatctctctttaccttactcagtgcttgttgagaacctaacacaaaccaggcactaataaattagaacacagtcacaatgctgctactgatcagaagagtaaacactctatgtaagaggccaacagactaacacagagctcagacggggccgactatgatgaggggatgcagtgagttttccaagagcaaagagggagaaataattatagggtttgtgcttgagatcagtgagtacccagaggaagctctgatttaaagtaggcatttaggaaagaacacaatcggccaagtcacaaaaaggggagaaggagattttagaaagattcgggaatgtcacaagtgtaggcattgaggtaggaaaggttttgccgagagagaagcatggaagccaacagtgccagcttggagagtacttggggaacaagcagaagctaggtcacgctatctgtttcaaagctggtatgtttttcttataactctgttttccctcacaagtataaggttcaacccaaatcgattactttgtaagagcttcaattaaccagaaaattgtctgaggatgctttgaaaaagaagagcaaaagcaactccttattaatggcacaaaaacacatgttccttacagggataagagaatgctttcctccatcccaaagatctgcatcattttcagtaattaaaaagttgaaattcctaaattttgaatctccaactcatgcaaaattcactttttgctacccacatcgaaactgttccagatcccagctcttgagaaattaaaatcacttaaatcccacaatcatgctccacactgataactgacattgccagctcttctagccaggattagaaaggtgtgttctatctaagcatcgaaagaattttagttagatgggtggcaattatccaaattagaacatggccatttgtttgaagatcatgaatttttgttattatactttaagttctagggtacatatgcacaacgtgcaggtttgttacatatgtacacatgtgccatgttgatttgctgtacccattaactcgtgatcatgaaatatttttacttccaattgagtctggcattgatttaatcaataccccctcacggccactgataaattttcataagccaccaattctaaaattactcgaaagcataaacagcagcgagcagaacattagatatcatcagatctggcatatcgcttctccttgggtgcctcctacaagctccagtataatccatgaattcacagttgatggtgaatcatactgaggttatgttagaatttctaatgaagaagctccattttgatgcctccaccgtgttgccagtcaacagcatgtgttctccaactctctccctctagagccgaggggtaaactcagtctcctaaacctcactagcaaagtccttttcaatcaggtctcatttttctcagcctcttagggatcaactctctcataggaaatttttcttctgcccacattgaaattctcaccacttcccagacaaatcatgtttgctgggtactccgtgcttctaggaagccacgcagccaaagtcaccttctttgtaaatcttttccaaattctctcaaacatatttcattctttcctcctcagagctaccatagcagcggctactcaaatccactgtcttgtacttattaactcatgagtttatccctccacaccaggagttcttccatgttttatctgtattctgctcccttgcaatcatgctagcctgggtttccagattttaagagaaactccactgattcctaagcctaagtatgaatatatatcagtgactgtttaaaaaatatatatatcctactatgcagaacttctggtagagaggcaaccagttaaatagttagggaccagagagattctgaatgtgaatggcgaaagaatgtaagatgctaccaaagattaaagctcccaagaaagagaaatttcactgaacagatgcagttattgtaagataaaattgatggactattaaggaaaagcgtagactctggctctcccgctgggcaggatagaaagtttctatcttttactaacacagtctgtgaaggaccaaaagaagctgaggcaagtttgatttgacacctgattcatgacataataccttcctatcagaccaggtagttagggccgggtactaaacacacttataaaaataattaactgcaatgagctgaacttcacttaagttgaaagatgtggctcatttgtggaagcagtaatacattgtttttgtgaatgtttacacatcgtcagccaagcagaggtctacagtagacaagtgtcagaaacagtagttaaaaattgaatttcaagatgatttttcaaggctccaagagaaagttaaaaattaaaagtgggatgcaaattaggctatgctggttttaataatctattccacatgaatttcatcaggctgttctttatggctttaaaggttttgccaatatatttacatctacaacatagttctgatgttgctggggggaaaaaggagcagaaagatcaatagctgctataccacacacgttatgttattaaatatctcacttggcagctattgacacaaagtgcttcaaaggataaaagtaatttacctcaagtgctccaacaccaactataccgccttcataaaaatgagtttctgaaaaagctcttagattttgttgttgttatgttccatttttaaagcaaccaacttaggttaatcaaaaatcaccttgcgattcctgagtggtttctgtatgtcctaggacactgtatctctcccatggtgtttaagtactagttacatttgcctgcataaatactgctctgctagtcattacttttcttctacaagttcatctctcggaagaactgagccaatattcagtgctgatcagtggcaagtgccaaaggcttaagattgttaagccacttactaaaggctcttaccaaagaaatctagatttaataaccgtttataagaaatatagtcctcaccttggggatagccgacaaaattgacttgtaccttcctgaaaagcagtctaatacattttcatgacctttctcttccttcctggctcataaagaacactccagagcccccttttcatatacacgagtgcacaacaaagataatctttcttgcatactaatgggacagaaaatgtaaagagcgttcctttcttatttttaataagggtaattaaattctatccatccccctttgcacagaatctctttgaatgcactttcttcgttaaattttcatgagaaacatcacaatgtaacagattcaaatagccagagctgttacacgttgacagttgtggcttgtttccaatttgactgtcaggtatttggcaataaaactcagtattcaacataaaacaaactgtagaaataatgaaatttctaattggaatgcttatctccgtgggtgtagtttagaagacgttaattgcttttttcttcaccttccacatttattagtgatttatataaaactgccttggccatttgataacatcaattttgacggctcctcaaatgtgtggtaccaggaacttgggaatcaaatcaatatccttaataacttaaccacacaaactttcacaggaaaaagcagctagcaaaaattaacaaattgtcaatatgctagtagctttaaacttttacatgaggtgaaaagaaaaacattttgtcctattcattaatgtgctcattaagctttaaagtgccttacttatcactgttccatattaatattcaatcatgcagaattagctactaattcatcaaccatttaaatcagacttgaccttcacaaagccatttgttctgtcattttgagaggccattaaagggcagattactacatacttgtgcttagtgaatcatagagtcatacatattttgtttggaatggcagctataatagacctggaaatatagcaccctctttgaatctgttggtatcttaatgaaatatgctgatacaaaactttcagttccattaaggaaagagaaaaatgaatgtaagcatcttccagagttaacttcccattgtggtagaacttattaacaaccctgacctacccaggacttgaaaggaatgaatccatgaggaaaatagtctgacactgttttgtaggtagtcatgccttacatatctgtgaatgatcaagtaacaggttttacatgatttgttcacttaaactgttttcactgttcatgcataaacaatattaacgatgctcttactttcactccactttcacaaacactgaatctcttctttgtaaggaagccaggaaaatctgaattgcctgctaaggctacaggctccttccaaggtggtcctaagtagctcttcttgcctaatcttgctagggctcttgctgcgtgaattcaaccagactagtcctttgactctgaccccaactgatttaacgaagtcttcaataaagaactgtttgccatggtattgggaaaaatcccaatttttaagattaatacaaatatgtttataaagaaaaagcgtgtcaattacatcaattacatcaatgcttcttcaagtgcagtatttaaaaatttggcaagtatacctgaacacttagatattattgacaatacagaggttttggcagtaatggcagtacaataaaacaaaaacacaatatggatgaagagacaagcagctgttatcatgaagcattcatcccctggaattacttttctaagtttcaaacagttcagagtggctcctctttaaaagtccccaaatagtgttatcaataaaccgtaataatagttagtatgtaagtgtgaactcttacaagctcacaggagggcaggagctatttgttactttcttcgtaaccttcccaatgttcaacaaatactcacaattagacatttttatgatgctttgacaattactttttcagcactcactcatgaggtatctctcaattcctcctggaatgtcattcattgaaataccattcctcaatgccactcactgaaacagtcattcttcaactgtttgtgactacacatttggcctccttgagtatcagtctattaagaggcaaagctatctcatagtctcattattttagtgtcataaggagtattagaattagagacttaaaaaatggctgtttgtgactttattttcacaatctttagtttcgtcagcaagtgattttccttccattgagaatatgcaatttatgcttttaatttatcacggttgctatgtgagaagcacacaatttagtccttgcttccttcattttacaggaggctttccctcatatattggttttcagttcctacgtgtcagaagcatgaccacatgacaaaaccacatgtataaacacaatgacactgcaaagaacacaatagaacacgtatctatattctactgttattctatctatagaataacaatggaattcttggtgttgaaactaatggctaaaaaagcccaggagtgaaccactcagtttttttgttgaggcaaacactgtgggtcttccttcactgacaggaatacagatttctaagtcactggatatcttacggtttgagtcattcatatactctcacagaacaagagtgatttcttttctttgacgggtggaaagactgagtgagaaaagttttcattaacataagaaaacaagaaaaatgatagacgagtaatatgcagcgtatttttaaaatgacattcctagagtatatatatatacacacacacacacacactaggactgtcattttaatatatataatacatatatggactttttcacgtgtcagagaatcagtagtgttctatgcagcagaaagtcagtggatttttatacttaagaaaaagtacgaactttctcggaaaatttaaatacacattggtcttaaggtggtcaaataaggtggccaaatagatactttaaaacaagatatttatgaaaattacaccatatattgaaacaagaagataatttgaactattagttctaaaaacctaccggatagtcaacagatggcatcattcattctacaaatatttattgaaggcctcctttgtgctggactgggccaggcactgggtatgaagtaatctagataatctctatattgttgtgatttaattgtatctgcaggataattagcttctttgaaagtaataatagtaccaagcacatacacaggaagattgaattagatgatgcattaaatgtgcctagtgctgcctggcactagtgtctggcatctagtaaaatactagcatatatgtacttgctttattccaagctccatcaatagatctaaagggatcagaggcatgtgactctaaggcttgatcaaacaagtagtgcagcaataaactgcaaatgagaaattattctatgcaaatcataaaaaacaggggttatctagacacgcaactaaatttaaagcatagtgtttgtgccaagtaacctctgcaaagccaataaataccctcttttccctttgaacaagattttaggctctttgattaatcaacagtacaaataaataaaatccatattgtcagatgatttgttcctaaaaatgaattttaaaaatagctctaaatatttgggatgtcaaaggttgttgtgaacaactgaaaacactggaaccaactgtttttccctatatcatggcaggcatttttcttttagttattcagggaaggggcattaagtattcctcatcttggggagtaggtcatgttaagaaggctatatggctttcttaaagaaaatagtttttaaaaagatgatgccaagaagtcagagttttgttttttcatctcaaaagtttcttaacattctgaaaataactgtttggggaaaatgatataaatcaagaaacacctctgtacaaagtctccataaactagttctaatagctccattaattgttcagctctggagaggggaaatctctcgatgagatttgtctaatatgatgctcttactaaatcccacctttaacagaatggaatttagtcagaagatcatattagacaaatttaaaattttacctaatgcaaagcactataatgcccagtatctctaaaatacaaatatttgaaccttattagagttccttgaggtaaataaggatggtatcattatcatttttttgtggctataaaacaaaaactcagtaatattgttatttgtttcatatcctacatgtagtaaaaaattaaagaaagtctttcagctctagatttggtgtctttttattgtgtcatgtttcctctatgcaaattgctattcttcaaataaatcttcatcatgtagtgatgaaactcttaatcacagtcaactcatgaatgggacaacaaaagagtttgaatacttggtcatcctttacttttattttttaaatggcatggactagatacgcaagttccatgagatgtaataatactttaaaaatagatctacattttaaaaatccacatatatatacatacatacacacacacatatacacacacatatatacgtatataaatgtatatatgtgtgtgtgtatatacatatgttataggcttctcattccctcaggattggttctagaagagacagaattctgccatgtctgttagccagtacaaggtagatgagaaatggaagagtgtgaaaaggctgataaatgtcaagtaattttcctagagagctgagatttagtactgtgcctatacctttagcccttctgtaatttctacttaattacctaggaagggctgagaatggcgggccttctgccatgagcaggcaccaaaagtcagtacagagaccagaaaagcagatataagtagacctaacatatctaccctatgactttgggccacaaggtccctcttcggtttatgggactaataatgactactccaaagctttatctggacagggagacagatcagtgtctcagaggctggaaggcagaggattatcatagtgtatttgctactttgtcgaacaatgagttttcaagtcattacatttcaaaatgaatcacagtatcaggctacaaacaaggaccaccattttctttccagaatacagtccttgaagaagaggaaaaaacattcttttcttaaaggaaacagtgtaaataaagcttttattttcaccattccagatggcagcagggtataatttgtactgtgttgacatcatgaccattattattcaaagtcaattttcctgtaagtgaattgaataagggactgaaaacagaaaaataaagagcaaagaaataaaagctaaatcaccgttttctagcaaagttgggctcttgggccattatcgaaatgttacgcatatgaataaaattgaaaaaatcatatagtttctaattacaaatcaaatgctagtccagtcagcaagaaactatataaagcagaaaaaaaaactgacagttaatacatgacattccaaatggaacatacgataaatataagatctgttcccaaaaaagtaattatgaacaagatacaaaaatttttttcccaaggtcctctttgcaagttattacatacagatagtatgcttgtcttaatatggctataaatcaatcagctaagcttttatttcagagtagatttaggtatctcttaaaggcagtcactggatacaagagtctcgaaagatttctcatagaattatgccatgcaggaatagaaaattggacattgttaagctaagagcctcattagcagctactaaatattcagcataccaaccagctacccacagagcattccagagcaaagctccattttatgaaatattcctcacattttgaggagtttgcaaggtactccgggcagagaataaaacaaactgtttagaagcaatgcatgcaatcatcctacaaattacaaagtaatgtctacatagcagaacataaaccccagttagatttaattatcatttgtctaaatgtggtagctccaagtttacattgcattaagttaaggcatactgttattagtgctcggcctgagcaaatgattaccctttttgtgattcataatcaaataaacgcattgagaaaaaaaagaagtaccttctcctcctacctagtaacactattaatacctgaacgtttaactaaatacttaggcatcagggaaacacatttattcccttctttgggattcatttagataaaatccaatatccatccactttcacaaatctcattattccctatcaatttatatttatcaacaagcaggtgtcattatactcaccctttacatccatccaaatgtttaccttactttgaatattcaaataattaaccactttaccgaaatgtatatttaaatcataaaatgaattttattatttttagaaaataattttttattcttgttttttagaaaaagaggcacaaagacaaaaatagtaaacaaggaaagagacttggatttggatcctgcatccattatttgttagctttgtaaaaagttacaaaccaacaagctcaatcaaatgggactacagaaaacattcaatgtggtttcttcaccatattttggtaaatataagtatatatgaataaattttctaagccatcaaatgttataaaaaaaagaaaatcagaatcaattgtgtagtgttggattggaactaatagtgttggtgtgaacacctagttttaaatatatatgtacacacatatatatatacatttgtatacatatactatacatattttaaatatatatgtatacatatatatatgacttgtaaatgagtatgcatgcacaaacatacattctttatataaacttagcaaagacatcttccctagctgaaccaagagaggctgggagcagtaatacccagtagcaatggtcacaccttgtattcagatcttggtttctaaataccattctccagttgaaaggaaacactttcctttcagaaagcttcccttcagaaaactccttagagaaatcactgattccaattaggactggaacaagcaaagaatgagactggaacaagcaaggaatgagaacaagcaaagaagacacaacttatcctgttgtataagaaaatactcaaagaatgaaaggtatatactaaatgtacacagaagccagcttaaaggggctcttattgaccaaatattggacaacttgaacacgaaaattaaaaaagacagtattaacaagttataacacactgaataaaataaagacatgcatccatactgatataaataactgagtaaattaaaagtttcaggagaaatagtatctttacatagtatcaaagggactccctacataaatttattaaatataaagaaagcagtctgtgagagattaaatgatagggaaagtcttaagcatctcctagatttgcagtatgcaattagaaaccaaaaatgatgctccttatgctgctgctgatgccaatgatattaatttagaaaataatgctcccatttacatgattttgctgtattctaagcacggtagtagtcctaaaaataccattaaagacaaataattttgaagttttaaattttaaaaattttaactatttttaaaataataataaaatatgtaaagaaaaattagtaactttacattggagaaggcttacagaaacaaccttgattaaaaaatcaaagttaataacaccagtaaagggataattcaaattcttgtgctgagaaaaatataacatcacttccacaatattcctggaaaagagtcacaacctaaatatgaccaccagtaaacatcagcaaaaccccaaacaagaacattttgttaaataacaggctcgttatcttcaaaactatcatggtcagaaatgtcaaagaaagactgaggaactcttccaggttgacaagtacaaaatacaattctgaactggagcctctgtggaaaattataaaaacttgaatggcgataactggtgaaacacaagtaagaacaactggaaaaatgtgatcaaaagtgaatgcggatctaagaattagatggttatgatgcatcagtgtttacttcctgatttcgatagtcccattgtagttaggtaggagaatgccttgtttgtataaatctgagtatttgggaatgacaggcaaggcatcatgtcggcaattaactctctaacagttcaggaataataagttctttgtactgtagtttctacttttctataagattgggatcatttcaaaattttaaattatatagaagtaaactgttataattaattcatattatcagaaatatatagacttattcccaaagcatctgggtagctagatatactcaagcattgctttcccaattgtgacaaacattcttaaatatatactttatttgaggccctcttgaataccatgactatttaaatgacactccaactgttattaccaatttcacacaaatgatgacaatatctgaaaaaagttaactctaaaaatacatgaattcctataaaattaaggcataagtatttaattacaaacaatgaacaaaattgagtgataactcaagagcaaggtgcaagctcatgaaaagaaaatgtgagaaatcaatattctaataacataatgcacgtttattatttttatttagagaaatgataaagtctgataaaaatttaagatagaagacaaactttttgaggatcttccttccaattaaaacataattaacttagaatagcttcagaaatccaaatgttatttttttaagccaaactttcaaaaattttagaaacaatccaccttcccctcagctcatcacagttctctcttcctgaaacaagaacacattacagaaaatggttgttaccctctagtctttaataatgtaaggcaatgggagcaagaggaacaaaataaagtgactcagatatgtctaaataatttttctaaaaagagcatttcactattttaccacattcagtaacagtttttatagttttaaaggcaaactgtggtaggtatttgttttatctgacaggagaaaattgattctgaaaacagaggtaatggcagttttctttagagggtgtcttgaaagatgaaaagatcaaaatcttaaaacatcaaacatcacatataaaatgtttcactgaaaaaatgaaaactacaggagtacatgaataagcagttaaagataacttatatgtctcagaatgtattacagatctatggggaaacatttcccataaatgcaaatagttttctatttatatggcaaaattcagcctgaatttaacaccagagaataaccaaatggaactaggttttttgttttgctttttatagatagggtcttgctctgtcacccaggctggactgcaatggtgcaatcatagttcactgcagcatcaacctcccaggctgaagggatccttccacctcagcctccagggtagctgggactacaggcatgtgtcacaatacctggctcaattatttttatttttcatagagatgggtctcactaagttgcccaggctagtctgaaactcctgagttcaagtgacactcctgcctccactctggagcagctaggaccacaagcacataccaccatacccgtcttttcttttattctttttgtggagatgggtttttgctatgttcccagggctgctctcaaactcctcctgggttcaagtaatccttccaccctggccttccagtgctgggattaccagcatgcgtcactgcgcccagcctttgtgtttgtttgtgtttgtgtgtgtgtatgtcaatgtatgtttttcttcaaaatctttgaaatcacaggactatcaatttatgaaactgcccaaagaagtttacaactatgatttatttcttttcgaaatgtttgaactttcctctctatcaaaagaatatcatatataaaagcaaacacaggatagaaatttattcactatgctttcaaatatcaaaaatattaagaagctattcaacaggagttcagacatctggaaaataacccaatcaaagtaaaactgccaaacaatggccaaaaccactaccaaaagttacatgaatgaaatcccttatcttttgcaactagatggaagagttgtcaagcatccacataaattctaaaaccttgaccttcttcttcaatagattaaacacagcaaattagaaaaagggtttcaggcaaaacctgagggcatacataaaggattgcgatctttttccaaaagcaaatgaaaggaaagaagggttttgaaggtaaatacaagtgtgtgggcacttcggtgcttgcgggcatgtgtactgggagtgtatgtcgcttatcacaaaattggcattaaaaaatggctttttaactgcattatgaaaaatgcattggggaaaagcaaaaaataagaataaagtgatgtaggcatgttatttaggatagtaccgagatagccctgtggcaagataaacttacattaggaagatgtaaggagatagggagaagtggaaaaagttcagaataatttgaatgtcaattttacaagggttggtaatattttgaagatgaggaatgaaggagaattatcagggatggctttctgaaatgttatgattgtttgcatatgttttcagtcatgtcttcccttgggaagcaatgtcatgtatttgaggcactcatgaaacagtatgcctctatgaaggactctcaccaatagagctgcccctggatggagcacagcactaagtacaaagcaagtgtctgtcagttgaacactgatccagcttttccttcaggaattggcaaaaggggctcgtagagcaagccgtttgcctccttatctgctttgtctcaggatgaaggcaagaaatgtctgcttcagcctacacacgtgagctcagcatcctcactacagacgcaccagaagttccctgggagccagtctagaatgggttgtaaatacccatggatttgcatcagttttctccactaatagctcaattcctgcaatttgaagacagttgagcatgcaagggtagtttctccctagccagaaaaggaattcacaaaatattagagtatgacagccaatggtctcctgaataagaggaagaataatttgagttgtgttcctatgaagacatgaaattaagaatctccttatagataactcacggctgtcacattttaatatacaacatgccaattaaatagatataagtttccaatgataagatgatactcagaagcgatgtaataaaacctttttcttacatattgaaaacaacccagagctgctcattttcgtttagttgtaatagactgacacattgttataaatttgggaaacatacaatctctaattcttaacaaagtgacagcaaattgacaacaaaaaaagttttctcagccttgaattcactggcatagcaacatgacataatccaccaatcccccaacagccacgagtggatggttttgatgtttaccacaagattaatgccccttcaattgctcagtgatgatggctatgaggctgctgaataaataatgtatgtgcattcactaaaggaaggaagaatgtgtatttcagccactgatccctaatataaccaatgctatttaagtgtttgttgttaataaagataaaatactatgcaatacagctttgtatattatacacgacaggttttgtgagcaaattatagttacatgggcacatgttgtcatttttccggaattaactcagaagataaaatataatcaagaatgtttccccagtgggaaaaagacattttcttttcctttttttctttttgagacagagtcttgctctgttgtccaggctggagtgcaatggcatggtctaggctcactgcaacctctgcctcctgggttcaagtgattcttctgcctcagcctcccgagtagctggactacagctgcgtgccacaacacccggctaatttttctatttttagtagagacggggtttcaccatattggccaggctggtctcaaacccctgacttcatgacctgcccacctcagcctcccaaaatgttgaggttacaggcatgagccaccatgcctggccaaaacattttaaatttagttttattttcatggatatcatagcccaccatagtactggtttttgggggttgaaggttcatagacttccatttgctgggaacctattgggtatatcacatgcattaggctggtgcaaaagtaaggttttgccattactttttttttttttttttttttgagacagagtcctgctttttgcccagtctggagggcagtggtgccatcttggctcactgcaacttccacctcccaggttcaagcaatttgcctgcctcagcctcccgagtgatctcgaactcccaaccctcagtaatccgcctgtatcggcctcccaaagtgctgggattacaggcatgagccaacgcacccggtcgccattacttttcaatggtaaaacagcagttgcttttgccattgatatgagcaggaattaccttgcaggaaaataaaaaaaataactttttttttttttttttttttgagacagagtctcatctgttgtccaggctgaagtgcagggacgtgatctcggttcactgcaacctccacctcctgggttccagtgatcctcttgcctcagcctcccgaatagctgggattacaggcgccagccactgtgcccagctaatttttgtatttttagtagagacagggtttcaccatgctggacaggctgatctggaactcccgaaccttcagtgacccaccattgtcggcctcccaaagtgctgggattacaggcatgagccaccatgcctggtcgccattactttcaatggtaaaacagcggttgcttttgtaccaacttatacataagttgcatgatttctcacagacttaatcctttgacaataacagctgggtcatactaaagacagtccttttttttttttttttttttttaattgtcaggaggcacttttgtatcaaagtgccttcttcaaagcttaattcactttcctaaaacatgatgaccagggtttcagaacaaaactttctgggatattcactttcctggtgcttcttaatatgacagagacttaaacatattctagcacacacaatcgtagtttttaaatgtttatcttggttgtgaggaaaaaatgcagctagtggtagatttaacaaacagcacattgctccactctcacctctcttttactctccagaaataatttttgttgattttcaaattcatttcccaacatcatggatattattcgttttcatacttatattttgtccttgacaaagataatattgtttgttcagacatacagggacccatttctgataattcagtttttcgtgattccaaatggaacctgtaacagagttaatcgggggtacctggactccaggatccctaagttcatgagacaagctgttttctggattattcttctaaaaagcagatcaaatggaaaacttctcaacaaaattatttatgaattgcaggacatgaggtagttccgaggaaaaccatgtatcttgataaaacgtataacatttcctagaacagagtcaactatcactgatttcatcacagtgattttcagaaggcaaggactatacagatcaactgttttacagtcaaagtcatgctctttggtaaatattctgaagtgtttgactattttcaataactgagtctacagagacattacctcattcagtttattaaagtacattatttctactgattgatcaccattgaaagttcaaatggtgtttaaaagggccttttagctttaagttgaatgaatgacatggatacttgtttataatttcataatagtttttcaagtttgaattattatagacatactttatggtataaattggtcattccttaatttcccattaagcctgttcaagaagaaatccaacaaactttatacaaactctagctaaacgtagaagtgctcactttgtccacctcaatttatcaggtggctagcctatccaagcacataatatcaccaacctctttagttttcataagaagatgtacctatttagccttaacacagatcagtggtaacatctgagatgcttcacttaaccgaccacatagtgttgctttcatctgtacttatcagggatctcaatcttaaaatgacagtcaaaacaacttggccagaggagtaatatttatggagaattagctgaagttatgcaatttcatccactcctccatataatataaaaactgattttggttagctaaaggatgagagagctagaaaccaggactgttttctctcatctgctggagaacagattaaactgacatgtgttttgttataattcgacagattaacctgagggactttagcaagcaactgccctataatgttgtgaaattaaacatgcatatgatgcagagaatagcatttactatttgactatatcctcgttctcaagaactatgggagagaacttttcccctggtttcaggggaatattatggtttttctttcttttttctttttcttttttttttgtgagacagagtctcactctgtagtccaggctggagtgcagtggcataatcctggttcactgcaacctctgcctcccagtttcaagagattctcctgccttggtctccccagtagatgggattacaggcgtgcgccaccatgcctcgctacttttttgtatttttagtagagatggggtttcaccacgttggccaggctggtcttgaactcctgacctcaagtgatctgcctgcctggagcctcccaaagtcctgggattccaggcgtgagccaccgcacctggccatactatcatttttctaaagaactgatttgttatttatgttatggacatgatgcatctgtgtcacagtttccctctttctcacgtctagagatgttagtagatttggagctaaaattgtggtttatttagcaaaggcacagaagtccatggcatggaccgtatgcacgttccaactatactcctaacattaacctgtcttactacaaaattttcctgctccactgtcataccattttatcttgctatgtgaaacattcctccataaactcttctatctctttgaaataaagttatcatagacacaggcataaatattgtagatacaaccttttaaaaatatataatgtacaaaagtgatgatctgaaagatgtcagtacatgtccaaatgaatccacatttcccataacagtctgagaaatgttaaagtcacccaaagttatgctaaaccaaaaacaataaacttattaaagtgagcttaccagaaaggatataaaaaacttaatttagtaaacactaacttaaaggaaaaaataaaggaagaaagaaataaagatagggttaaataggcatagtgggccaggcatggtcccagcactttgggaggccaaggtgggcagattgcctgatctcaggagtttgagaccagcctgggtaacatggtgaaaaccagtctgtacaaaatatacaaaaattagcctggtgtggtggcatgtgcctgtagtaccagctactctcggggctgaggcaagaaaattgcttgggcccaggaggttgaggctacagtgagccgtgttcacaccaccgcactccagcctgcgtgatgaggtggaatcctatttaaaaaaaaaaaaaaaaaaaagagagtgactattatttctattttagaaaagtcacaggcattggatttaattccaatatcagcccatgataaaaatgataaatatcacaaagatatatacccacacaaaaatacatatataattatgtgtggatatgtatgtttgtacaaagcacatgtttacattacttgcagaaaattataatcacatttaacaaacattaaatagcagtgtattatttgttcaatttaacaaatatttattgaacacctctcagactctctgtgtaaaacattgctcagcacctgacagctgcaaaaacagtcccttaaaagttgtaccatgtaaggtgaaaacgtgcatgtgaacacagaaaatgtgtcaactaatcaaaccctaagggagcacaggggtgaataacgattttgctggagaccagagaaggtagatctaagagcatgaatataattttgatagaaatgtagtaaagggccttcaaggcacagggaaaagtataatctaaggtccaggaaagattaaataagtgcgaggtggattcaaggtgaaatgcggtcactgcttgaatgcttttgtttgcggacaggggtaggaagacagtgtgcaaggtctgttgaaggatgatgcaaagatggctggccaggtccaactgtgacaagctggaaggaatctggggttcatgtgttaggttgtatatgcatgcagctggaattttgttttttttttgagagaggtgttcactctgtcacccaggctgtactgccgtggcacaatctcatctcactgcaacctcaccctcccaggttcaagcgattcttgtgcttcagcctcccaagtatatgggactacaggcacgcaccaccaaacctggctaattttggtatttttagtagagatggggtttcgccatgttggctaggctgttctcgaactcctgacctcaagtgatccacttgcctcgtcctcccaaagtgctgggattagaggtgtaagccattgcacccagctggagctggatttttttttttttttttttttttttttttttttttgagacggagtttctctcttgttgcccaggctagagtgcaatggtgcaatctcggctcacggcaacctccgcctcccaggttcaagcaattctcctgcctcagcctcccgagtagctgggattacaggcatgcaccaccatgcccagctaattttgtatttttagtagagacggggtttctccatgttgaggctggtcttggactcctgacctcaggtgatccgcctgcctcggcctcacaaagtgatgggattacagatgtgagccaccgtgcccgggccacagctggatattttgaaccaaggaagtaaaagaaaaatcttcacattctaaaaagcaatctctgtcaagggagtgcagtgaagggggacaaagagaaagcccagttaggtagttactatattagtttaaatgtgagatgataaagtctatgtgcggatataacatagaattataattatgatcgttggaagagaaaggaagagatgagttagacgcatactggagaaacattccaccagttttagggagtattcattttacttaaggaaaaatggggtaagagtcagtgtcaagtttctagcctcttagttccttcgtgaatgatggtaggtcagcaggcagggatgatgtcactaatataaaagacacaagaagagacagagaaaggtcaagatttgtgtttctctcatatgaaaatgacagctggaatcatgcagatggatgagatgacccagcaaagaatttacagtgagaagagtatgggaaacaggggttttgcaatgttccaagtatgttttccacacagtaacatttttgcatattcctattaaataactaaaagggataagaacaattatattattttgcattgtagattttaaacatagagaaaaatatgtgtgaatatttgccttgtgaggaggggcatatgagaaagtaatgcaactttgagaggggagatgaagtaaaataaacacaagatataaaccccaagggaaattatttaaataggaaatataaaattattcaaattgtaaattatctaggaaaaacacccaataattctaatggtagcttaggatattgagccaattttttaaaaattattacaaaagaaagatactattcttaactcttgcttcaagccatgcaatcagacaaaaagggtaccatttcaagctctttcatttagcgtatctatattcagatctccattcatatagttcctggcatgaagcatctgaaagaagattaaaattaatgtaggagtgcaacattaagacaaacatcactgattaacttgaactgaaccaagctcaaagcaaaagccataacagggaatcagtcagaattgaaaagaacaaatagaagacttgtttagtttttactgtattccccaagaatttgaaaaatttagggtccaatttatattattaggaaaacaaaaagttgtttttcatgttctattggcttatgattgctctggccttttaaataggcctacattccaatataaatattgtcatgttcctaagattagtatagataccttacatgtatatggtacctcccaaatttgaagtgtcatgagtattaaatgatttaatgcatgtatggcactcaaaagtagatttgtcatatagtaaatactttaaaaatttactattaccactactgctgccactactgctactactagattgtatgagattaacagtaaaatcaaaactatattctgcattatttattataattagttgccctgaaatattttaaggccatcaaaatcttagttggttaaatgacctactggataatgtatctaccatacacacaaacagatacgtatgtgcttatgtgcacacacattctccaacataatttgtggaaagagtagcaacaaattaaagaagagatcatgattttcaatcacctaaataaatctaaatccatatgcaagagaaacctagaaatatggtataatgtaactgatagtataaaagctcagccctaagatttcttaatagatccattggccctatagtctacagctttaactatgagaactcctgacaagaacacccaaggcagatccagtgttcaatctttcttttgtacaggcctgggtcaggctctttagagaaataagaacgcaacagcaccaaggctgggtatgaaaagaatattctctccacgggcctgtcttcgacagtgagcttatgctatagctctcataacaattactcatcaccaacaatagcatcccagttctgcagtgacagtgtggttgaatagatttcactcctggcactcccatgataccataatggcaaatccctatgaaaacatatgataagactatcacttgggggtggtttttgctcaatagctattttattcccttggagtattttatctttcttcataattatatcaaagggtacatttctaataactggtaatcccttccttaagtgactttaacctccgtaggcattgggccccatgacccatagcacaaacatattttgtaattaaattttttttcaatttcagaagccattgaggaaatgttctgctttatataattgttctccattaacagacatttaatatgaaagttttcataatttaaacccatttaatctcatccttatatgcttcatatctcattttatttttgctgttttcaacaatcaaaacccttattattatagataagagagtatatggcagatcttttttctttctcttttcctttctcttttccttttcttcctctttgttttttaacgaaggctaatagttcttaactttagaagactaacaaggatgcaagagtgatacaatttttcaggagcctgaagtaccagtcattttaagtagcttcagattacaacctgtgtgggaaatagcatgatcattttcaattacttcatcatgaaggagaaccattaattagttttaactggaaattgctaacaacatttctacaaagtttataggtgtaataattcaattttccaaacataatgaagaaagtccacaaaatgttgactatgaggaccaaatcaacctctttttgcctagaataaacctgcacagactttatcaacatataatcagcagaatcaagcctggaatagatcaaaccagaaatgtgatccagtcatcctgttccaattaaagaatggaccatgtgttgaactaagcaaataagtgtagataaaataatctatgttgggatttgagtacaacttttctggctgtacttcaattgtagctaagatccaagttgaaaagttctggcaatactgcccccatacccaccatatattttaaaggaagctatcaatgacctggaccagaggcctgtgaccatcaccttgcttttttcaggcgatggtcacaggcacctccttgcacggtttctaacagaagacagaactgacctattaccaataaccacaaccctagcaaaacccaaatccaaaccccatttatatacaaaactgagaaaaggaaaagtcacagatctttggaaagtacagggttctttctctctgggaaaaatcattgtatggtttggcggtgcctgtcaaaaagggaaagtattagcaggtttctcttcttgctgtgtcagaacggaccagcgtgagagagtttttgacagagtatgacatgtgtttttggatttggtatccacttttctcccagagcactgtataaagaagcctcagtgaggtgcatggaaagaggacagaggcattcacaccaaaccaccttcattgcactcttcagaggatgaagaagcagccctgggagacttctcgcagcttcaggagaagattcatgatgaacggaggccaagcaaataggaaatccaaccagcgaccagatcaggtaggcagcataatggctgggactgaatatggatgatgacccttctctggggtgttcatgagcaatgctggaggaaagaagaagccaaatgcaaccccaagaatacctactctcgctttgccctctgtggtggattgataatgaccataaatttaattctgagttggctatatgacttgcttttgacaatggggcattagtaaatgtgtcacaagtagatacttggcaagtcactagcactggggctgcttgtgagccccacgactgccgctgtgtgacaaacacttctggagaacaattgcctctgttgctagagccaatagcatgccacatcccagacacattctgcattacccagccatcagctaccctgccacatgaccacagacccaagagagagacagtataaatcacttgagctggcccagactagaataactgcccagctgaaccacagaatatgaagaatcgttagaatggctgctgggttaaacttgttataaccaaaagttgagcaaaacactagtgacctgctttacaaagtatattatggcaccctatagattacaactaaactcggatcccaaatcaacttaaaaatgctatgatacagtttttgttaaactgtgcctttatagaaatattagtgaaagaaaaaaaggaaaacacagagtagaaaccctctacggaagcagaaaatagtcaatgtggagttgctctgacctcaagcagcttgaaagagctcaaacagtgggcctgagtcccctggcgtggcgtgaaaacaaggagcaatttggtttgctttcatgtatcttctgataagttgaagtagtggaatgcattaattccactctaaaataattaaatcaatcctttatttatcagtcgtttactggacacttaccctatgcaatcaactacactatctaccaggagatagtaataataaatacgaaagctatagaaaagaaatgagagaggggaactggagtatacctttatgacaggtacatgactcagcattctaaaatgtatgctctcatcgcttctcagccttttggctaagatcaagcgtctaaaatgtatgttctctttttctaaccataaagccctataagaaccttcttcttatgctcagagaacctatataaccctattttaataagctatgaccttgttgtttgcctgtaaattctatcctaacttaaggagatggagcacctacagtatggtacaaaaaagaaggcggccagtctcttacgaaattcagagagaaaaagaccacagattagccgggcgcggtggctcacgcctgtaatcctagcactttgggaggctgaggtgggcagatcacgaggtcaggagttcgagactagcctggccaacatggtgaaaccctctctctactaaagatacaaaaaattagccgggcgtggtattgcacgcctgtaatcccagctacttggaaggctgaggcagtagaatcacttgaacccaggaggcgaaggttgcagtgagccaagatcatgccattgcattccagcctaaacgacagggcaagactctgtctcaaacaaaacaaaacaaaacaaaacccacagattatagttggggaaggaaggatttaaaaaataaataaaagctttgttaacaaggaggattctgagttatgaggaagagaaataaatctgatattgctagaaatagaaaaaaatgattattctcatgttttgatatcacagaaattgattttaatatagaaatattttaaatatgggaaagtaaaaagtagggaaaaagtccttgttttcctctaaatgagctataaataaatatcctttgggtcaaggaacttaaacttggagtgtagcatgtgctgggaacacagagaggtatatgatcaccccataaaaagaagaaaagtggtttgactgacacagaggccatactaagtccaattgtgacacattaataggctaagaaatggactttgagtgccaggctattgaagcaaatttagatggctaggtataaacagaaatacaattttataatggttctgctaaaaaacagaaagctaatcctgggataagaattcattcactgtccaacacgtttgtttattttgacctgttggtccaagcactgtagagctgtcagagaaatatatgaagcagcacacagaagcctgcaaaccccacaaaacactaacatatttgtgtttttatacgctttctatcatttttacgggctttggtgttggaagagtaaggtgatccaggatcagagtccatcaagttgaaacttaagtctctttgtacttatgagtatatatgacttagctattgaaaatccaattatgtatatatacactatatatataaaaaattgttcctccagatacttgcttctaatttgctaaatgttactatatcaagagaataacatttcttctattataatttactaacttcccagaataagtcagatgcctcctcaaatatttaagactcaaaggggccaggtgtggtggctcatgcctgtaatcacaccaatttgggaggatcacttgagcctaggagtttgagaccagcctgggcaacatggcaagaccctgtctgtataaaaagacttttaaaaattagccaagcatgacagtgtgttcctgtggtcccagctactcaggagactgaggtgggaggatcctgcgagcacaggaggacaaagctgcagtaagctgtgactgcgccactgcactccagcctgggcaacagagaaaaaaccaaaaagactaaaagggagtaaaagcaaacaaactcttacttggtaatcaaccacatgttagctttgggaagctgagagttaatgcagaaggtttttatatgagtccatgtgtatttccccatgggtaatttgatgttaaacactaaatccaagtttctcagaggaacacagtctttaaatggcagcagtatcatcagccttgctgccttctggctttctatcatcttcctttggacatctctccaaaatgggatctggtttttattttagacacaacttagaatgcagtttcctatagtcaggcagggacaatgaggatgtcaatgaaatctgaagtaacaggaaggatgctttgtctacatctagaaagagagtctacacgtgtaggggaagcactggagcacagattgcagatggactgaaagtgggcaacaaataagaagactgataaacattccactggaccacgggtcaaggtccatcttggactttatattgcacccttggggaagcatgggagtacagaaatgggtcagagcagatgcagatctgtgaagacatcttcatttctctgatgtggaacaaggacagatggatgtaaaaaatgtgtcttggcggatctggaaagagcatgctaccctttgggaaaacatctgggctgttacattgttttacagcacagaaggcaagaatttcaagctctctcgccctgcttaagacttctgtcattcttacactactctgtcactgagaaagctaaaaatttattcaaaggtctcttcaatgaaatgcagattaaaggcattttgtgcatataagtctggtctcttaggcagcatttaactttactatgtccagagcatatgtcataactaatttgggtcatgtttgattactcactatgggtcaaagttgaaattctgttgcaaaacaccagagtaaacttaaccatgaatgtttttctaacagtctgtgactaaatgtgtaatatacactaacaacaacaaaaatctgtggccaatcatggactttctaatgcttggaaatggctgaaagtatatagaggatattcaaggccaccaaaatatactgtgctaaaagcacttaattagcaaaggctaactatacatctgcatgtacacatacttgtgtattttatatttctttatatatctgttagaataaatatgcatttaattaatataaccacacatttctttcctatccaaggagtccacttgcatatatacaagggtttgctatattataagaggtcactttcactatgcacttagttacatatgcttattctgtcttagaatgtacaaatttatcattttgacaggtaaaaaaagtgtaagaatccaagcagaaaatatttgaagttacagcatctggattggtaaggaggctaaaagagatagcataggtgacagaatcgaacccatgtctttcattgatggtacaaggtgagtaacctaatgaattagaaagacaagccaataaaaggtcccgagttgacctttatagtccttatatgcacatacatctttaaattctcccattatataaattaatacaatattggcaatattggttgtttcatatcagcacaatttgtagctgaaattgattattaggaagtggtttgtggtatacagtaaaggaggaccagtgagaggaaggagtgcccattcagagagcagggccacagtggaagggaggcagacagagtgatgcagtttgcttctgttagccgaggtacaggggaacctactccttgatgaagatgaaccactctggcgccatgaatacattgaagattactcagtggtcttgacaacggtcattactaatgagagcgaacttcctgaaatcaacagcttgcctaagactagcacagtgtctgatatgcagcaagaactcaatacatgtcatgctctgttattggaagcaaaatgatacctattctagtccattccaattttgaaacttattttagaaacaaaactctttatttttcatttgtaaatacatatatatatatatatatatatttgggccgggcgcggtggctcatccccgtaatcccagcactttcggaggccaatgtgggcggatcacctgaggtcaggagttcgagactagcctgaccaacatggcgaaaccatgtctctattaaaaatacaaaaattagccaggcatggtggtgggcacctgtaatcccaactactggggaggctgaggcaggggaatcgcttgaacatgggaagcggaggttgcagtgagccgagatcacgctactgcattccagcctgggtgacagagcgagactgtctctcaataaaaaaaaaaaaaaaaaaaaaagaaaaacaaaatacacacacacacacacacacacacacacatatatacacacacacatatgcatatatgtgtatatatataaatttataaatttgtaggtatacatatcaagaaacaaggaaataaacatagaagtaaagatcattttctacttacttaagtttactctaatttttttgtctcctttaagccaccactataaatttagagaacgctttattaactgtgaagcctgaaaaaaaattatgtaactaattaatctattatttctgctacaataagtgagcctttgattcttttcccgatatagaaataatgatgtgtgtcagacaatttttaaaaatgagaggtacagagagacggacaaagcaggccttgcctccctacctaggtttgactgttttaaactttaaatgaatactcaaggatttcctccaggatcattaattagctatttccttatgcaaacggagacaactaaagatgttttattttcttcctctatatcttctctcctttatgtttttcattcagccttgccaggaagaataaacatgagctgagtcacctgtactatttcctaatagtgattcatcaccaagaagcagtaacagactctccctcctttcttccctctcaggatgtggtaccaacaaggcaagtctcacagagccatgccacgtgccacatcctaaccttggattccccatatagcacctcccagagagctgaaatagcctggacatctttcaggcctgctctgatggagagagctcagaaacagccttttcacatgtgtcagattttcatctctctgaaacgtattaacagtttacatggcaggccagatgaagcctagaacccagacagtcaacgggcttgggctattgtacaaaccgttatctaataaaaaatgtctattattttaggtcagttgtcatcactatccatttagtttatggtgagtgttcatattaatgttaccaaaatagggtgaacatcctttatgacaccttatcttacgtgtaatcatgacttgacttacatgcaatggcgaactgaaataaaatggtaattgccacaaaatggtgcttggcattctaaaaaaattaaaatttacttcaaaattcctttagaggtaatatatattcatcagaacttatcaattaattgagtaaatacaaaaacactcaaaataataatattcacaagaagtacaactgcgtttaaaatctgaatgcctggcctacatttacatagtctaatagctaactgaagttttacttgtttctatctcttttatgccaaattgtttttattctgactgagatgacataatattttaattttcccagaaaagaaaaaattaatgcagaaaaaatcaacaaaaattcagttagaagaaataagttctagcattcaatagtacagtagaaaaattatacttagcagtaattcgttgtttatttcaaaagcgctagaggaaatgaactataatggtcccaacacaaagagaaatgtttgcagtgataaatatcccagttatcctaattttattgtacattatatacagatatcgaaatatcacatatacctctcaaatatgaactatatcaatttaaaaattcaaatgttcatattgtatcatgtgcaatcaaattttacttaatgcaattcactatcactttgaaacctgctcttgggctaggtttatgcttatttcatctgaatagagaaaccagaagttatcatccttaaataccatcctttgtggatgttcccatcatgaggacaaagtaataaatttcagttctcaaggatgagaagcccaacagattcactccttttctgcacacagaaccatgctggcaacagtcccaatgcctaagcttcagtcacaactttcagaaaggtgctatcaagtggggctgcaaaagaatccctctatcacctttcaaactgacacctgtgttgattgcttgagcccatcacagtttagctctcacagctttaatttactagcccatgagaagtcagcttcaaagaacaccatttcgactctcaaagaacattatcaatgtacatggatagcttccaacttcataaggtgtttctctctacctagagcaattaacattaatttgcagaatagtgtttattgaaaacctttgtgtatctccaacaaagtaatagtgtattgatttcattcctactatcttcaactgtatcattaagaggaatttcttaggaaagtctatatgcagtaagcaagtaagatcgcagaacatcaagggagaagtaaatccaaaactgattttacttcttttcttagtgaggaaagaattatgttttaagcttgcctctattcatataaccttaaaagtaatcattctgctttttgtgggtttattataatttgaacaatgtttataatctctcaattcaaaaaatcataatctgtacatgttgatcaaccaagttataaaaatgagatgaatttttaaactccatgcaaatctttaagagataacatgatctatctgtccataaccaagtttaaaactttgttgataacaaggccaaatgcaaaatggggggagtggaagaaaacaatacaggtaatttagacagaggcaagtcaaatgatcagtaccaacttaaaaaaaaatacatacacacacacacacacacacacacacacacacatatatacactgtttcattgtcaaggctctttcatattaagagtaatcaacatataattaaatttaaaaaaatgtatgtatagatgagtatccagctatataaccctgcagaggagctgaacaaagtcattcaatgaattgcagatgacatagcaatggaaagaatgaattacctttgtagttatcttcccacacccaaccattaaacaaacaggaccctttaaagactttaaggtaaacagtggtttctcaaagtgatgcaatgatcatgctgtgcctgtataaggagcataaaatgttcttcacaacagggttatccagtgtttagaaggaaatctctactggcaaatggatctgtctttttgaggttacagtttataggctggattcaaacgacaaattcctcaggactctttagcctaagtgtaaataaagatgcagaaaggcattcctttaaaaaaaaaaaaaacactccgtagacatggtgatgacagtgaaaggaggcagtcaaatgcctagtcagatggggcaggatccccttttaaactccacctccaaactgaagacagtttaaagcctgaaagccaagctaaaaattaaatccttggaccagactgagaacctgtcttcccatttgttgcactttgttctgattgatccccacccttcatgtattttacttatccctaccctttcctaattggttttctacactgtcctgcccacctttgagtggtgtcttcgctttaatcttttttgaatattcacataccaatcagcacatactcctcattctgagtccataaaaagccccagacccagccacactgagaaaaaaaccacccgactgaaggggtgaggaatcctcccaccccaccgctgcccctgactgtgagctgttccattgttcaataaaattcttctctgcccatcctcacccttcaactgtcagcctaccctcatttttcttggacgcaggataagagctcaggaacccccaaatgtgagtacaaactataacacaggtgggctagggtgcacccagctcagccatgggccaagccggtgtacaagcgagactcagcgggctgactgcctccagcagcaggcccagggctgagcaaggtgggggtgagggggggtggagagtggagggcacatcaccagctggaaccctgcaaattgtcagaaaattcctgcgtcagtgattcagtgatatataaattcaaatttcaagaattcattatttttataaagtctttaggaaaggatccttggattttttttttttttccattcaggagcagtgttggcaccattgtaaagggtaagggtaacggttgagatgtccaaatatacatatatatttatatatatttagtgatctaaatgtttccagtgccaaagttagatgctttgcaaaactataactcctttaaatgccatccatcttgaaaaaatgcatgtcacatcactagaatgttacttatagtcctactagagtttaaaaagatgtttcctaaagacctaccatttaaccacaaactgggaataacctaatatcaattggaaatgctgttaaacggaaacaaatgtaactgatacatttgaagcaagaggagattgaagatgaaggtatatatccaaaatggtgacagtgacagattctgattttcccattttgattaacagaatttcctataggcatcaataagctataaggtggataagatagttctgttgtaaaagtactgaggactcattatctggactctcaattctcattattcagtttacttagtttcataaaactttaagctaaatctatattctataaagtacatatgacaatattaattatattgtcacctttctaagattaaaaaattaagtattttttgaaaacttctcagttcctggcttggtttttccttctcataataatttatttatttatttattttattttattttatttttttgagacaaggtctcattttgtcatgcaggctggtgtgcagtggtgcaatctcagctccctgcaacctcgaactcccaggttcaagtgatcttcccacctcagccttccaagtaggtgggactacagacatgtgctgccacgcctggctaatttttacattttttgtagatacggggtttcaccatgttgcccaggctggtttcaaactcctgagctcaagtgatccacccgcctcggcctcctaaagtgccaggattacaggcctgagccactgtgcctggccaataatatgttttgaggagaaaattttaatgcaatgtaggttatcattaagattcatgtttttggtgttgtagctgaaaaacatttcctaatccaatctgcaaagattttctttttttttttttttgcagaggttttatggtattatgatttacatttagatctgtgagttaatttttgtatttggtgcaaggaatgagtcaaacttagtgttttttgcatatgggcacccactttttccagcaccaattgttgaaaaggcagatgagtagataaataaactgatatatccatgtaatggaataccatttggcaataaataataataaactactgatatgttgaacaacatgagtgaatatagaaataataagcctgagtgtcagcttggcacaagagtatacacattgtaggatcccatttatataaaagtctacaataaaaattaatatatagtgacagggtgatgactgtttgcctgggaagcgtattggtgaggctacagtacagacagccaagatggaggaattacaagtgtggtgaagtttcgcaggtctatgcatatgtcaaaactatcagactgtatgttttagatatgtgcagttgatcacatatcaattgtatctcaataagtatctatacatatatacacacatatgcatatacagatggtctcctacttacaaagttttgatgtagactttttttttttttttttttgagacagagtcttgcactgtcacccaggctggagtgcagtggcgcaatcttggtacactgcaacctctgctcatgggttcaagcaattctcctgcctcagcctcctgagtagttgggactatagacatctgccgccacacctggctaatttttgtatttttagtagagatggggtttcaccatgttggccaggctggtcttgaactcctgaccttgtgttccacccgccttggcctccctctgtcacccaggctggaacgcagtggcacaatctcagctcattgcaacctccaccctccaggttcaagtgattcttgtgcctcagcctccagagtagctgggactacaggcatgtgccatcacactcagttctaagtttttgtatttttagtagagaccaggtttcaccatgtcagacaggccagtcttgaactcctgacctcaagtgaatctgcctgacttggcctcccaaagtgctgggattgcaggcgtgaggcattgcaaccggcctcggcatacaattttcaaactttagacggtgcgaaagcaatacatattgagtagaaactacactttgaattatgaattttgatgtcccaggctagagatatgtggtacgatactctctggtgatgctggacagcagatccaagctgtaactgccagtcagccacatgatctggaggataagcaaccaatacactatatgtactgtgtttcctgattattttttctaactgttagctaatgtaagtattctaagcatgtttaaaattgggtaggctaagctatgatgttcagtgggtttgacatattaaacgcatttttgatttacaatattttaaattatgatgggtttatcaagatgtaacctcatcaaaaatcatgatgcatctgtatacatacacacatactatcaggcgtgtttcaacaatctttttaaaataaaagttgatattcaggccgggcacggtagctcacacatataatctcagcactttgagaagctggaggcgggcggatcacttgaggagtttgagtttgagaccagccaggccaacatggtgaaaccctatctctactaaaaatacaaaaaattagccagatgtggtagtgcgtgcctgtaatcccgctactcaggggctgaggcaggagaattgtttgaacttaggaggcggaagttgtagtgagccaagatcgtgccactgtactccagcctgggcgacagaatgaagactctgtctcaaaaaaattaaaagttgacattcacaatcaagtcatgttacattgatcttgattggacaagaatctccggaaatttttatttatccaaatgcatatgtaggtatggtgggttggtgtgcattcacttattggagggaagagtctaagaaagttttttttaaagggcctaaataatctaagcaaaataaatattaatccatgctagccacattgtaagtgttaaaatggaaagaaatcatgagattctcaaaatgtagccactggttggataaaaatcctcagcaaaatttgtctctagaaatacaaaagctccttcattgaaaaatgccctcaaatgaaagtaattatgaagctactcacaaaattagaagtaaaaactcaatgacggggagagacgaacatgtggccatgtaatctgctccctgctcgtggagtttcaagctaaccgcagtggttttgagtataagaaatcatggtcacaggaacagggaggaagtgtggaaaggggtgggctggaggaccggggagtttacactgccagatatgacaactcttcgcacaatgaagtttgaaatgtaatcaactgctattttaaatttgacctttttttccctagaatagtaatttcctatagactgctttcatgtgagaaccatatttggttgcttaagaaataaactattaattcactacccacagaaaggataacattcatttgttatcaaatactaaatgctgcacattgcattagactcgaatttgaaatgtaattcctatgcatgagtagtgtttcaggaaacatttgcctcccatgttttctccccttgacacttcacgttttagatctttgttgctaccatacagaaataggtgcatttggtttttaaatactggaaataccatacttgacataaaaattatatgaaaaagagcacatctaaaatggacatcaagaggaaggaaaaaagaaaaaatacaacaaaagattcagtttcttccattaattataaatttaaactgctaaagatcctaaaatatttcacctttctggctaattgttctgcatagtttatgagacgcttatcaaaaagaactggggtaagttattcatcaaagttttatcattaatagcattaatagcaaaagcataccttttggaaccatggaatattacagaaatagaaagttgcagttcaaatgctgtttgtatatagagagaaaacaagaagacaaattttatgagatttcaggtacctcaggactggttttgaagtattatagatcaaatatgtgaaggttataaaccagggctcccaggtaagctggtatagaacaaaatcaccagtggaacagaaactgaaaatacttccgctgaaaagatatatactgaatgcaaaatatgtgtgtgtgtgtgtgtgtgtgtgtgtgtgtgtgtgtgtgtatagcaagtttcatttatagaccaatgcattctctttggcaggggtagttttttaagctactgttagaaacatatgaagaggggtgtatgtaggagaactgcttgctctagggttaggtgtatttctacttcaagaagaaagccacccaaagaattgctgtttcgaaatctgtacgaatagctgagcctctcttgttttcttcactcatgttcctaagtaacagacagcagactaggatacttgggagttacatcccttatttggctgtttgaactataagactaacagcatatcaaaagctgatcattaaaccctcctattttgataatatcctcagtatgaaacagcttagtgaaagacagaggttggccctaacagcaatgttcattatagccataacttcacctctgagtagggcaagagttgaaggaacagatctgagtagatcaccagtagctctcactaactgaagcttcttgagggcaggattatccaattcatatttgatcctcagcgcctagcaatgagactgaaatacgttagacactcatgattatttgccaaataagaatggagtcaaattcatatccattgtgaattacccagaaactatacattttaagataaaaagtgattgtaaacatagttccagcccattcctcttaaaaattctagacaaggtatattgatggtcaaatgttgcagttctcaaaaagtctccagcctggacactgccttgggtagatctggtcatcagtcctggttgctgctccaagtaaaaacttcattcttgatttggggttttcttatcacctgaaatacccttttgcaaggtatgtttcttacatctctcctcacataaactccgtaaaaccacccctctcgaatgctaccttctccaacgaatctctcctatttatcttatttgtaagtaatttctccctttcctaaatgacacaatattttatcagtacgttataaacaatgtttcacattgatgcaatgaataactaccagaaatgcaaaaaacacaaacaatgcagatgggttccatgatgaatttggcggtacctgccttttccaggcttcaaggctgctcttatttttcattcactctattgcttctgcctcaaatatcacaacctgcctgtaatcctgttccctcctctcagacaaatgttctttaaggcatagctcaggagtcactttctccaaaataatcttccctgacctcttctccaatttcagatgagtaaggtgttgttaacgtgtcctactcacctgcttccatagtaccatgggcacatgtccttcttcactaaggataccacattgcagtgatctgggaaagcacgtcttctcactgacctgagttctttgaggaatggaatggcacagtcatcatggtatttccagcattttgctaggcctcagtgccacagtggctgctcaatattttatgaataaatgaattcagttatatttgcgtgtaatctcctattctagactgtgtgctctttgagctcagtaaattcagtatttttggtacacagtagatatttttaaatgcctcaatgaatgaatgaatcatacaacctttaggctggaagtaattatagatatttttagtcttatttctctctcttacaaataacatatgatgaccaagctaggttctatacatttattcatggaatcaggatcaaggcataggtcttcagattccaagccacacaatttattcttgtatactgtgacatttttgaattaattaattctatatgaagactaaaatattaaagtcatcactatgaatatatatttagaaatgagaccttattttcacggaaatttaacaaaactggctgtcaaccatttttaatggattctcctagtatgtatcagaggctgacagttacaggcaatccattataatagaaagagaaacatgttatattctaaatactgcaaattaatcattaataataatttaaaaatccaatagattttggtttagtcagcaaaatgttttaaatacaagtgttctatacattgcagagatgctaagttacatttaataccatttatcaaaaccttagggagttattctttgggtctccaaatctcaaagacattaaaccaggaccaagaatttcatgaatactgtggcagattcctccctccctccctctctactaacagtgatttcaaggcaatgtgacagcaacttacacattacctgtcaatagcaatgacttagccatcatctccctggaacctttcattcctattactcctaaatcacctataaagaaattggtaattaagctgctagagacatctgggctaaatggattttgagccaagaagttttgaaaggctgattattaaccttcggtaaaacacaattaagagaacacaccagactcattctcagcttcagtaggagagaaaggtcagggctatatgtgtctggtagatttaattttctatatcactattagacagcctagattatttttaatctggttacaacaacaaattctactgatttttgaatcaaaagtcaaataaaaacctccagtataaacctgagttttctgcaagtattttctttcagaggcataacagtctccattttctacagaattcataaatatgaatattttagaaaatgtctataagtgttggtcttctaagttctcggtgctgcctaaagtaaatatggtaatactcagttgcccacctatgagcttttgtgtgtcattagcacaaatctaatgcttcatatgcagcaatacaaacactaacatcatttcttttatatagaaatatgcttcccaagtttaagttcaaaaacacatctgactttaaacaaaatcatgtttgttgtcaatgttttattctctctcccaaaaaccttccttcctacctccagaggcttcctctcccaaactaacacatctttcttcagcctagggagttcattttaacccacgtaggtgaaactctctttagataccctctaacaaggagggtacaactcctcccaccccaagaaccgctatctcttccagccttaaaacttccagaggaaaaggttatgctagtggttacagaaagcaagaccaatattttgcagaaggaagcccattctatccaatgttacccaaatcatatcaggcaggcaatcatcctccaaactgcttgaaattatgaatgcagaaattaatgttaaaatgaaaatgcctatagtcctctgctacagacaggcagagaggggaagaactttactaacctctacctcagaagaactctttctctttgaggaggaacatcttccataaaaactggagaaaaaattgggccttccaattatcacacatctccgttcccctcaacaattggtgtgtctacagtcccctccatctggtagtgatttattttcaaaggatgaaaattaaaaagaatcacaccttgcaatttggcttatcgattccttttcatttatctaaactgagcagtcatataacatccttaagaaaagagactttaaaacttccactgcttaaaaacatccctaaaagaaaggacttaagaatcacctctatcaaagaaagtttgtttattattttaaggaagatataaattggaaaaaaccatactaattagaaacttgtaaaacttccatttgaattataaattcatgatgaaaactaatacaacacaatatttggatattttgttatacataatgaaagtttcagatttgggaaactgaaaaatacagagcagatatcaacaacatttgggtacataatgcggtgaactgttagaaaaaccacagtttccgtaatgaagttgtagtggaagtacaatcaccatcgcataagtagatatcagccaccatactatgcatcctcttacaacagcaagaatgactgttcctatagcagagatcgagtccattagaatttcaaccactgaaaaatgggttgagaccacataatttgctagtatatgtgacttcattatattaaatagggagatttttatatgtaaattgagattattaacagtaatggtcataataaatacactcctcataatttattgcacttcagtaacatactatttgccacaatacaaatactttcaaaatcctaacaagatgtgctcaaaactaaattgcaaaacaaataagccaccacctactgttaaaggttagtttaagtatttcaaaagcaacaatttaataaagattaaggaatttaataagcttcccttttcctttaacaaaaaagctttcaagagtcaatgagcaacaacaagaaagggaaaacactagcacattaaaatgtggtgtgtaaagtatggtaataaatacacttaagagaggtaggttttaataataacaaatacatttttttttacaccaatgactgcccgttaggcacattcttaagtcaacttgcatggttgtggctatttgtcaaaacttacttcatcatttacagtctcagagttcttttccttttagctcaatgttgtgatggaatcaatacagatctgctcttaaaatatctgtctctgacctgtgtttgttttaagctgtatcattcataatggtgatggattggtaatgctattcctctttgtctgcacaaagcaccatggcataaaaagcacatatattttatgcccaaggtcaggagaaaattaatggataaagagctagataaaatggagttcaagctgaatgggctgagagcgctctacaaggtacagaccaggcaggcagtacaaagtccattatacttaaacactcttgaagcatttcagaagtgaaattgtttccacaggctaacacataaaagcaccaagctctcacatggcttccactgagtgcccacaggtatgggcaaagtactcctgctcacgagcttccacggcatattccatttatcaatttttaccttgagcaataagcccatttggtgtttatcaccagagttgaacaagttatgctttgttgtcattagcaaacttctcttttaacactttcctactaattctatttctattgttcactctcttactgtgccttgtgaatacttaagagtttagggtctcccttaagaggcagggccagctgattccaacaaaaacaaagcttcatagctaacaattacacgctattttccataacatgcactctcagacatctaaatggcagcaaactaagtagaaatttaaaataataacaaaaacaaagaccagtaactgagaattctaaagtttggcatgcagaacaccatcaaaatcatccatgacaatttggctgataatatctatgcataaacataaggaaataagcattttgcctagttaagcagtccaaaaatcaatggttttcttcacaaaccttgctgagaaaagcaatattactattttgttgaatataaaacaactgagcaaagccatattagaatttatcctaaatacctcactttcagatttagaaaaacaatatttaataaatagatagtgtaagtgggttcttccatttgttcattttaaggggaatgcatagtaacagttgtgatttgtccttatagttgagccttcaaccctgtgacactataaataaactgctcctggagctgcggaaattgcccattatctccaagagcatgttctgataagagtccatcaacatgaagccaaaactcattcagagcatcaagagaggaaagtttctagtgatggtttggtcatggtctctttcaggatgattgcatggcagaggaaggaataaaactgtgaaagaattaaagttggtggatgcggaagtaatgtgtacagtgatgatatagatattaaagccaaaatgtggcaactctgtttgacaccgcaaagcaaaatgcattttttcacgtaatttagaaatatattcaggtagcactcaaagagctcatttaatattaaatataataggcaagttctgagtgtcagttaaactggactgaatgtttgagtttgtcataaattaggtgtggctcacccaaaagcataatctttccattttagtttctttatttgtaaaattaagagtcagaatatagcctccaaggactcttctacctaactaaaaagcaaaaccaaacccttccaaatatcttccatgatattctcttaacataaaaagtcccaggtttatgatccaaagatagagatcttggcattttaacatgagtgcagtgacaagactttctgacctgagtccacagggcagttacacacataaaatgacttcagggaaactcttcacttagggaaaaaagcaattatgaggaatttgtaagtattataaaactatttttaaaatagtaatagaaagctgaaatgaagagtaatggtctaaagctaaaaaaaggaagaaattaacattagacaacacaaaaattcttcaaggggaattaggcactagaataactgcttagagaggtacttgagtcaacctcattggaggcattcagaaatagattatatcaaaacctagcaggaagtctagtgttactccttaacttgaaaaaaataaaaaacaacgtagcacatttccactacctaacttaccatattttgcatattattttccatatatttcatattactgtgtatacttggtgctctgattatattggtttgcatgattctattttcacatatatcctaaatatttccaaagtttcaacacactgttattataagcttaacatttcaaaagctggttaaatattcaacgttgttgatatattttaacttcttattctggtaaagtacatttagattataatttattgccatcatagcaactcctatgctacatatttttgttcatgatctgttggtttctatcaaattgaatcctcaatttaaactcctatgactagaaataccaaatcaaatgagtatttcacacctctggctatgtattgctacttctaaagccctaggtatgaatgaatgcatgacaactcagtgctgccattttaacatgtgctgataatacgttccaaaaattctaaaaaatgatgtgcaaattttgttattctcttacataactaaagaaaggtattggtgctactaaagatatacatatttatttccagtatgtatttaatatatttattcctgaaatgaaaagataggcaaagtagttttaaaataatctataatagaacactgctttaacagaatgaagacagacttaaatttcttgagtgttaggaaattggggagaccctggatcatctcaaacaatactgaagatactcttcacaagtcagttcactctgggtcaatggcaatcagccagataaatcttgttaatattaaaactggcttaaagccagacagaattcatttttttctcaattaaaatagatggagccatctttcttgactattaagcatatctctaatgttcacaagcctgcctttgtttcatttcctctccctataacataaaaatgataaaaaatattctctttatccaaaaaagttgcataatttttatcacattagaaaaaaagcatcagtaggagtatttatggaacattactcttaattctgcatttttacctatgcagaacattttgtaaccagtgttcaatattatgattaaaacataaatgaggttaatatttacaatttgtttatatttcaattagaacaattttagaattcatgtgtgcataagcttggcagaaaataatttctctaatgcatattttaacttcatttagggctgactatggtaatactaattattcatccttgtattttcagatagttggaagaaatggcagttccagggactttctggttcctcctcagtacaaaaccatttatatcatattctattattgctccatctcaactcctgtgcaaacctattaatacctacagatactgcacggaacatgctatgccattcacaatttagtctttcagattgaaacatgtcttaattcatctcaagaaaagactagaagaaaatggtagttgcttcttaaaattaccaaaatcatgatcatcactattaacaactgataatacgccataatgaacactctttggcactgtctatcaataaatattattttaatttaaactattcattttggacatcatctactattgtagttattataatattgtcctctgataaaaacatctgaacattttaattcatgatgatgatagttgggaggccctaaaaattggtccaacactttaaaataatgtataataaattaaacaccaaaaggcattaagcaataaaatgtccattaaagcactgtatctcagcagctggaaaacacctaggtggtatatatagcaaaatataagtatcaaatatttggtggtacatatagcaaaataaaggctaaccactaagaagaaaaatatttttcttgcactttccacatactttgttattacttttaaagttcaaggcatagtttcctgtgggttcttttcatttttcttcattcagtaaaataaatatccatcttcagccagacattcattcctccccctgagctattaaaactcaattaattgcttagttaattgccaatcccatttaaacaactcactgctgaactccaaacaaacttataaaatgaagtgatatgctgagattcataagcagtcacaaatgtaaaaataaatttaaaaaggaagaatatgcatgcccaagaagaaatggcttcattaattaaaaaatcaatatcatataaataaagacaaataaaagcaaattaattcaaccttggcaataaaggcacaagataatttggtcatctatttcattaacgcgtttgcaaatagatcacacttcatcagagggtttacagaactgtcctcgtactctacgaatagctgttcaagtagttcaggctgcaaacaagtacaagacttctgaccttctacttaaacagaagtttttaaagttggtgattatatatcatttaccaagagtaagctaaattgttcctgaaattaactcaaatcacttgtgttcatgagaaaaggaaaaaggcgattatatatttatatatttcaagcagggtctgagtgaattgagtatccagtaccaacacactcaagtattctttttagtccctaaccgcttacttcaaattttcatagaaaaagcagcaatttaattctaagagtatatcaaatgcattaaatagccctgtacggagtggccaatgtactaattcatatgtgctggtgaactctttgcctgttgctgtcttaattcttgaaaataaattacaggctagtaagtatccttcgttactgtgacctccctcaccctatggattttaccagacgataatctagaccagtgtctctgcaaaaacgtggctgcagaagagatatattcgtttatttggtaagcaacaatgaagtacttaagtccataaattttccattacaatgtcagaaaaacaagaaggctcactttttgctcaagaataattcagaaaggaaaaaagcaactgctcagtttttcaaaatgagtttaagttgcaaaaacaaatgggaaattgtgcaacaaatgtagtgactctaagtcataaatgcattaacttaaatttattaactacagtacctaccatgtgctaaacactgcacagggtaccaaagatgcaaagactagctagggatgcttcctcagagggctgaactccataatcgactctgctatacaggagatgtactacaaagatttcagcagagaaataacttaggtcagtttacatttacaaatgagatagtcctaacagcctttaaatccccacatgttgtaatggatgatacttagtatgcatgaaagcttgggagcaaataatgtttgcacaaactgtttatctatccttataacaccaaaccttgaagtgttggaagattattgaaggcttttttttccttttaaatattaatgtgcacacttttcaaccaattgttggcatagaatacctgcagcaattcttgattctatcatatttataaaaaataatgtcaatacctataataactataaacacataatactaagttttgttttatggccattttgaacttcctgaaataattctgcatttaaggcagacttccaaatacaatgaaagactcttactgatatttgtggggagaaataatggttcttttatggtcatgatttgcatttttacagattatctattatactttatgtcttttccaatgtttcctaaagcttcacattttggttgtattgtaaaaccaaagtaaacaaaatttctacaggttaaggtcataataattagagttatgtgtagttctctttttgtgtgcatatatacacccacatacatgtatatagatatttaatcttgtctttgatctacagcaaggctaatgcagcaaaaaaaaaaaaaaaaaaatccatatttgcatatccgtgtctctttcctaagtatctctagttgcatgtttcctgaaaagagcaaaattcaacagagccaaagtaaattattccctaccaccaaaccttcacagatatgttccctgcaatcctaatctcagtgtatgccacctataccaaaccaatgccaacccagaaagcatctttggtgactctcttccttagtggcaatattcaactgctattgatgctaccttttgagttactgtgtatctcttcttgccaatcccactgtcagcagagccatctggacctttatcacctgttgtctattttaacttcagtactaaaaccctccaatccattctccttccacaatgcagctagagccaagcttcaaaacagcaaatatattactaaggttttcctgattcaagtctttttgcttcaaagactacccaaactctccagcttccttttttccactctccccaccatgacctgtactccagaatctgagctaaattagagttctgtgaatacacatcacttgagcatatgccattcttgctgcctgaaagaacttgaactcttttattttttatttgtttgtttgtttgtttatttatttatttattttgagatggagtttcgctcttgttgcccaggctggagtacaattggcgtgatcttggctcactgcaacctccgcctcctgggttcaagcaattctcctgcctcagcctcccgagtagctgggattataggcatgtgccaccacacccagaaaaaattgtatttttagtacagacagggtttctccatgttggtcaggctggtctggaactcccgacctcaggtgatccgcctgccttggcctcccaaagtgctgggattatagacgtgagccactgtgcccagcctacctttaactcttgttaaggatctctctcaccaagagatccttcaagacttcaatcaaatcctacctccttttgaaagcctcccctgacttctctaacatactgagcattgcctgtctctattctggaaacgactttaatacatctttgttattctacttatactcaactgcagtagctataaatgatggttccagagcagcagcctctgcatcacctgggaactcattaaaaatgcaaaatctcgggccctactcaagacccgctgaatcagaaactctagggatgtgggactcagaaatttgtagttcaacaagcctttcaggtgattctgatgcgtactgatgtttaaggaccccttttctattgaaatcctgtgtgtccatcagtctctacacataattgagaaggactttgatggttttcatcttcctttcattcttctgaatatgcaatacacatttgttgaatacagagcaaataaactggtaattaaaattagaattttacagttaatttcattgcgctttatacagatacagattcttagcatgctatcggtctgtacataggatacacacttgaaatgtgaagatgatcatgtcaagacgatagcagatatgatgcattgccaatagttttcttatgataatattcaccatgaaaaatgaataagatcatatgaagttattttcatgttagacaatagggaaacttaaaagatgctactaagagtcaagggccatttacaactttttaagtaatcaactaggtatactgttgatcgaacagagcccccaccctccaacccctatatatagtctatttattaaacagagtttaatgtttgcccttcataaaacatttcgtatataactgatattaaaagctgtaatactattatttgattcataatttaattcggtgtttgcaaacacgtgaaacaaaaactcagaaaaattctctaggctgtcaatacaacaaaatgctctacctatatgttaagagagtgcagaggcttggttatcagccagctatgacatagatggggctgagaagtggaaaggcaacaggatccgcccacactagcttcaagtatttagacacatatatctaaatggcaaagtgtttgaaatcaggactgggcttaacatgttgtactttattccccatcctcaagtgtcaattacaggatgtctgcatataatagttatttaacatattgacttaaacagaatttccatgtaattcttctttgcttaccattttgattaaaaagtacaggagttaaacttcaaattacatgaaattagtaatttaagttatttaaaagtcaattcatctcaggcattgtattctgttcctactattgtgtactacttctgtcactgatctcaatttataaatgtattaagctggatttataaatatttcagaggtgctctaggacagagatgatatatttttacctctgtatatgcaacacttacaagtccaaatctgtagtcgattttaaaacttaataataatttgattaataaatcatagcaaagaaacagggagaataaggatattgctatagcatggtatcatctaaaatcagttgatagaaacaacacaacattttctttgtaaatgtgaaagcactgcttaaagttccaaccaactgtccatctaatcttttccatagcttattcttcataatacaaaagcttcttttctcttggatctaatgctaatgctctcctggtatataatcctcagtaagaaataattttaaaagaaaagatataataaaagtactatccatgaagttttaaaactggaactttgctaaatatattatccttattagttttaaataccttgggtcaaaatatgcccaagaaaaactggtgactgttcattcattccacgttcatttgttcacactgacatttattgatcacctgctcatgccaagcattttaataagtcctgggcaataaaagtataaaaaacccacagtgcctgtcataaaagaagtcacattctaggggaacaaaagatacatatatagttgcaaaccaaagtattttaatggaataagagacatttacataaaggtattatcaaatcaaagtagggtattgaccagatctgggaaaggcttcatagagtaaggttgcagtggatgggaaagatttatcaggtgttgtaaacagagaccaggaaattaagctgaaggagtatcatgcagacgtaccttggaaggaatgtagtatgttagatggaaacggaaccaaaagtgttcatgatgggaagaaaagctggtgaggcaagtggaagcctggtgaccaggctaaacagttccctctttttgccacaggcaaaagtgaatcatcagaggtgtgaaacaggatagtggcatgatcagatttcactcctgggtggtagctatgaacattcatcagggtttgcagggattacaagtttccagtcattccacaaattattgaccaaaaaaattatattaaagggaaaatatatttctattaataacaaatgtgtcatgataatgtcaggtattaagacagaatatacgaaacaaatgtttatggaaagtgttatcagtagcagtagacatgtgaaaaaagactagtttgcctttggaaagataaaggaacaaggtaatatgcaaagaaagcaataagcattagagggagataactgacaaaccaagacagatccgaaatgatacatgactctaaaacattgaagcagtaataagaaaatagtttagaacaaacagcctaatcacctgaagtaatagacctaaaaagtggagtgacgatagcaattaagtttctcttgtagaatatagacccaaggtatgagaattttctttctttggttttaaatatatgctatatatgctgccgtctgcagaccctgatggactttttatttttgaaagtgaatacagcacctgaatgtaaagataccaaagtacgtgatagtctgaactatcagggaagtctttgacaggttaattaaaaagacttaaacttgaggtgttgtattccttatgacaccatttttagcactaagtagtgagtgatgagtgagaaaattgtgtaattattggaatagctaattggtggtaggaccatttgtaagtacaacaaaataggtattatggtcagccagacaaaagcagctatttgtatgtactcacgcacacatacacacacacacgcttatataaacagcaaatagcaaatgtggatacaatttttcgcaatgatagaaatactgttttgcagtgatcctgtggaagtaggaagccaaacagtagatcacatatcactgacatcctatttcccaataggtttgctgaaaaatgaaaagcagatttgttgttggtaattgcaaatgccctaattttcaataatgtaaaaattagaacttgtatatattcatatttatcgtgacaaacacactctgcagaaaagaatgttgtttagttcaattaattggtttggtactgggaatggccctaagaataaactccagggtgagttctacctggaagctggaacagagagtcaagttaaagtaactgtaagtaagatgctgtagatgccttaggaatatattataaaaaaaaaatcaaaccaaaaattaaagagttaatatttccagtcattaaaatggaaaaagagactcagtaattctaaagaaagcagaaattagcaataggtaaaaatagaaattggtgaaatacaaaaacaaagaaaagggaggactgacagaactaaattctcattgtttgaacacagtaattaaaatcctaaacttccagtgagtctgatcacaaaaaagagggaaaagggacacataaacatcataaagaaagaaaagggtggccggggccgggcgcagtggctcacgcctgtaatcccagcactttgggaggccgaggtgggcggatcacgaggtcaggatattgagaccattctggctaacacagtgaaaccccatctctactaaaaatacaaaaaattagctgggcatggtggcagatgcctgtagtcccagctacttgggaggctgaggcaggagaatggcgtgaacccagaggcaaagcttgcagtgagccgagatcccgctactgcactctagcccggacgacagagcgagactccatctctaaataaataaataaaagaaagggaagggaagggaaggggaggggaggagaggtgaggggagggaagggcccggtggctcacgcctgtaatcccagcatttggggaggtggaggcgagttcctgtcactgcactccagcctggatgacagagcatgactcaatctccaaaaaaaaaaaaaaaaaaaaaaaaaaaaagagggaaaaaaaggaggacagagctatagataatttacaaatttttaaatactaaaagaataaaagtttatgtctataaatttcaaaaatgagagggcactgataactttctagaaaatataaactattggaagtgacaaagatttgaaaatggtaatgacaaatcagaaaaaagctcggacataagtagggaaatctgctatgagacagaggcagtatttcacatcaggagagaaaggttgggactagccaataaacagtgttgggacaactatgcatccatgtagaataacaagattagatcgccactttacaacaaacagaaaaatccatttcagatgagttaaagacgtaaatgtgaaaaagtaaatctgttagatatatttattaccttgagtcagaatattttttgaacatgacacaaaaaagcaataatcataaaggaaatctaatactgtatatttgactacactaaaattaggcttttgttcagtcaaaaaacaaacatcataatgaggtagataggctagtcccagactgtgaaactatttttttcaatgcatttaactgacaaggaattagtaaacaaatgtgcataccttattgagaacaatgatataatagggaaaaaaggaaattaactggcaatttatagaagatgaaacatatggagaataaggataagaaagatgttcagccctactaggcaccagtggggggaaaaacaaatttaacaataagatactattttataacccttcagattgtccaaatgtaagcctctgaaaatacaaatattggcaaggatatgtagaagaggtaaatcttagttatgctggtagaaatataaactgggacaatcactggagacaaatggtgatatgtggcaaagttggtgggctttgttttgttttttgctatttaattcagcaattggatgttaaggcaaatttctggagaatttctatcttaggtaaataaagaggtatgtatgagttggagcactgcttgaaattggaaataattaaaaaccactcagaagctcattaacttaaaaatggattaataaattgggggttattgattcaatggaatatttaagacagtggtccccaaccgttttggccaagatgaaactgttccacctcagatcataaggcattagattctcataaagagtgcaccacctagatccctcacatacacagtttacgataggttttgcactcctatgagaatctaacgcctccactgatctgacaggaggcagagctcaggccataatgatctcttgtccgctgctcacctcctgctgtgcagcccagttcttaacaggccagagaccagtaatgatctgtggcccagggttggggacccctgatttagacaacatgtttcaacacggattatttgtttttagagacagcatgttagcatgttgccatgttgccaggctggacttgaactcctgggctcaagaaactctcctgcttcagcctcctgagtagctaggacaacaggcacaagccaccacgcatggctggataatttatttaaaaaaaaagaaacataatcttgaacaaaagaaaaaatcatgttgaagaatgataccagttatgtagattatgataccaatttatgtaaagtttgaaaacatgaaaacctatgccataaactatttaacatatatgcacatgtaggtgtaaaacctttcatggagataatatatacctaaattacgttgcttttgtcatctgttatgggaggtgggaggatggaaatggggaagaagatagagtagacttcaactgcaatgtttcatgtccttattctgaagtatgcatgacagaagagtagaatttaacagatgtttgttcattgttgtttttctgtactttcttcatttcatatctaaaaagcaaagttcagctgggtgcagtggctcatgcctgtaatctcagcattttgggaagccaaggcgggcagatcacttgagcttaggcgtttgagatcagcctgggcaacatcacaaaaccccatctctacaaaaaatatacaaattagccatcggtgtggtggtgtgtacttgtagtctctgctacttgggaagctgacacaggaggatcacctgagcctggtagttcgaggctgtagtgagccatgattgtgccactgcattccagcctgcacaacagagtgagatcctgtctcaaaatttttaaaaaattttaaaaagtaaaataaaaataaataagaagcaaagtttactagtacctccatagcaaatatattttccatacccaatcataaaaagcatttaaccatttctgcagtcatcaatgagaaaagaaatccctatctataaatacgatgtcttttctggtcacatcttgcaaccaaaccccagaccattaggttgggtagaaaaatgcacagatgctagcctcccttagattgccaatatgtgtgtgtagtacatattggtattggtactaactgattagttactgaaaaaaaaaaaaatttacattcttctctattatgtttttacttattatgccattccctcaaaatgtggcattctggtattcagcaaaaatactattggttttgattaatgccaagaggaaatctatcattcatgcactcatgctttcatacacatttaattatgtattatttttccaatgttctagagactctggttaagaaatctaccccagcatttcctaataagttgggtgtaaatataacaaacagcagaaaataatccagtactgtattagtccattctcatgctgcaaatggagacatacctgagaatgggtaatttataaaggaaagaggtttaactgactaacagttcagaatggctggggaggccccaggaaacttacaatcacgttggaagcggaagcaaacatgtccttcttcgcatggcagtgtcgaggagaagaatgagcaaagggcgggaaaagtcccttataaaaccatcagatctcatgagacctcattcactatcatgagaacagcacggaggtaatctcctctatgattcaattatctcccactggttccctctcataacacgtggggattaggggaactacaattcaagatgagatttggaaggggacacagccaaaccactgttaaagtactttaaagtactttaaggctcaaatgaatacaatgcttgccacgtgaaattttcaacgtagatcttcaaatatgaaatatgaaattcagttagtcaactctactaaattttttttaactgcagagttacaaagggagaaaaaggggaagagtagacagatgcttgaagatagatggaaacaaatttattatatatttaactttataaaaagaacaggaaattgtgaggctctgcagtctcctgggtcagtttcctgatgccctggttctgtcaaggtttaatcactaaactacaccaactatagtcactactttgtttttaagccactttgagattttcgctatggactggaaagtctgggatatgaatgcctaagcatgaagaaaggctggacaccataaaaatgtgtaagaattggtgggatttaatttcatttgggtcacattaatggccatgaacatgacaactctgtaccataccaaccaccatacattgcaaagtagtcctaactctatatgtaggtaagtcagatttcttagtatcctttacttgctcagatgaaatgtatttatttatatattctggtaaaactatatgaatgtctgccatgtgtgaaagttatttttctgagtgaaatttacaattgcattgaaaaaatgcttgcattttgccaggcacttctgatttctctgcctgtactatttcattacaccttttaaaagctctatgaggtagactatgttcttatgttagagatcaaaacattgttatggagtcagtcatctcataaatccacttgtcctctctctgccatgattgtgccatcagtcaaagattaaaattttattataaccaattaaactcataaacaatttgtggatttaacaataggcattacttttaaaaaataatttataggccaggagcagtggctcacacctgtaatcccaggactttgggtaactgaggtgggcagataacaaggtcaggagatagagaccagcctggccaacatggtgaaaccccatctctattaaaaatacaaaaattagctaggcgtggcggcgtgtgcctgtaatcccagctacttcggaggttgaggcaggagaattgctagaacccgggaggtggaagttgcggtgagctgagattgcaccaatgcactccagcctggtgacagagctagattctgtctcaaaaaataataataatttataatatcttgtgtattataaatagactctataaccagcattgattcttctgtattaagtcttcaccagctcatatttcttcccttcttcaccatagcagtgtcagcctctaccactcattccacattggaatctttcattgttctttgtgttgtccttatttcatccacttctgctaggctgggatcaaaggcaattatcaaaaaaagggaacctaacaggctgacttggttaaatcattccattttaaatattcaaaagttgaggcccccacaacacagtatgacttttcatatgggtaaatcaagatgagaatccatacctctagctctgcctcactacaacaagctgcctaccctcctacccccagtcactgtctatgcctttggttttctattgctacccacacatttgccaacggcattgctagaccaagtatgttcttaaatattttatattaatactagattttaaaatataaagtggtaaataataaagtcagcgaggttatcttgctctaactcctcacttaataaagaaactgaagccggctgggcgccgtggctcaggcctgtaatcccagcactttgggagactgaggtgggcggaccatgaggtcggaagattgagaccatcctgactaacacggtgaaacccagtctctactaaaaatacaaaaaattatgcgggcatggtggtggcgggtgcctgtagtcccagctactcgggaggctgaggcaggagaatggtgtgagtccaggaggcagagcttgcagtgagccgagatcacaccactgcactccagcctgggcgacagagcgagactccatctaaaaaaacaaacaaacgaacacaaaaagaacggaagcctagaaatattaagagaccagggttacactttttatttttatttattcaactacttacaaataataaaaatctgcagaggcactagtgacatgttatgacaactggtttgatcattatttagattttggatttatttagattttatattttaataattttgttcacctctgtaacagtacaaaaatcagcagcttttacagtaatgcaaggtttcttctaatttcactgaccttttcctaatacttcaaaagaaaagaataaatacatattggcttctgccaccgttgtagttaaacaaacttgtagaattcgaaaatatttaatcaaaatgttttgagtaaaatgagtaaaatataaccttctatataatattccttaaagtttcctaatcacataaaatggaaagctgaatttggaaaaaaatcaaattaagttcaacagactaaaagttctcttatatcccaaaaggaaaataaagatatgcttaggtatgaaatatctgacctcaacggccttggaaagctgtacatggtccttacagccaagtaacaaagaaatttgaaacatgtgttacaagaaaggaaagaggaaaacacttagtaggaaaggacaaaacttaaagatccataaatataaatcccgactgtggcaaataattttctgaatgtctgtttccactgaccagatgaaaatcgtaaatcctcaaagatgccaacaagtacttgaaataatcaagtcacgagaattaaggagtaaataatagctctgtgcatctcaggctaagaagccaagagccttcaacaatctaccagccaatgggcaattctcctcagaacacatgcagctcccccgtgacaattttaggtaaacctgatctttgcctatatggtgtaattggttttaatttaaggattttgttttactctgtgacttctacccatgagagcgaaagccagcaaagctaggctaatctgcattctgaaatttcattctgtgtttttattttcctttggagggttcttgttacagaagagcttcattaacttaattaggcatgatccagtgggcccatacaaattaggctagccacagtatctttagaatggacaaaaataagaagccagctgtagtctttatattttgaagaaaatcttaccagctgacatttctttgtgtcacagtcatattaagcttatgacaactgcaataaccaaaatgtgttttggaagttcaagtctccaacactatgaaatataaaagacacaacagtggatagggaatgaactgttttttttaaaccacaattctttttgtaggcatctagctctttgctttattatagaaagaataatcctttggtaaaagtgtgcttataaatcaatttataactactagcaatgtgataactgtatcagaaaacatttaggagaaaagatattttcattttcttcctagaactcacaggcatgtgtacacctgtgcatacacgtaccaagataatataatacaagataatacatgtatcagataatgcaaagaaaaccagacactacttgacctgcaatcttaggaagttattgattttgcctcaatttcttcatcaaccagcagaaataagaataaccctcattcttcttcagagaaatctttaggcaacttccctgtttcaaaaggataatctggataattgttaaaatagagattcttggaccatatttcagacatcctgaatcaggctttccaccgaagagccaaggaatttgtatttaataaaagttattcttagtgggtcactataaactaaaatataaataatgtgaaatccctatagattcttactgggttattataaactaaaaataaataggaaagctctatagaaaattttgagtgatatataagtatataccatcaacattattcagaatttctagcgcaaaggaaaatgttgcaaagaaagtattcttacaggaatttattctggctaacctttacactatgaagagttgctgtgctgatcaaatcaatcaacccaccaaccaaacaagcatcttcaggaagctcaacatatacccttctgcttctcagataagtacaaattttaaccgataaacactaaaagtcacatctcatacaataacatttaatgtagcaaaatactctagatatggttctcgtaagtcctggaattctggaactaaatcataaacaattaagcataatcacagcgactttctgacttgtcgcttgattctttataaatgtattctcaagaaatacaataagaaaacatggaagaaaaaatatgaaaaccttccaacctaattctaattatctgaattaaccatgttgaaaacaagatactacttggagtaggaattcactgtcaccataagctatttgtgacttaaaaactagaacatggagttcagaacacaatccaatttctgtagatgacagtgagttcccagcaggggttgttcctctccagaaacctgtcttggatagtatcctggtacttggttgcgttggcacgtctgccacctcagaaatcaacaaagtcatgcttccgtttgaatgagaaacttgacacattcctctgattcctgaactgtgcctacacaacctgttataatgttttgtagattgcagtgaatactgctgaagtctcacagtggctacgttcaatttcaaacgtatatttgcaaatttggaaaatgtaaattaggaaattttctggaagaaaattatgctggaaataacagaaattgcttgcgttcacttggtcaactaataatgactgaacctcggtaacaaagatttctggggttatgaacgtcggtttttgcaatgttcacgaggttccaaggattatgacctaggccatacttaagggtacatagatattatatctatacaatctgtatagatatagtacagtcataatatgagctggaattgattttattaaagctgataatagaaaccagatggtccaagtatctgaatcaaatatagacttccttaagctagggttgaaaatagctcaagaaaaaatgaatgaagttctaaatatgacataagagctctgcggaggtaatataagtgtggatatccaagaataataatgacttgttctgaactaagttaattacgtcttccaaggtattttatttggagaacgctgcatggttgtgtgctatatcctaaaattcaagtgtgcagaagacttatcagagggtgggtagaaagttgcaaccaatcaagttttacatgccttagtctctttcacttatgggtgataggattatcaagtttcctgtccttctcttcctagagattatatttttacatttgaagcctgtagctactttcccatcttgcaacccaaaaaccaaaaagacactgtgttcactaactggcactaggtatgaacagaatggatgttttcaaacaaatgaatgactcaaaggaattcttaaaatgtttctttggtgtgaagagcaggggtcacaaaggcatatggatagtaaatatagaaatactagggatttgcatgcaagtttaaccagctacaaaccaaacagaatagttctgtctaaaattaaggtaggtaattagtttcctactgctgttataattagctgtcacaaactcgatggcttaaaacaaaaacatttattatttttcagttctggaggtcagaagtcccatatgagtttcactgggttagactgaggtgtcagcaggactgatgttagcagtcctttatggaggctataggggagaatcttccttcttgcattttccagtttctagaggctgcccacattccttggcttgtgatcctttttcatcttcagagccagcaaaggccagctgagtctttctcattttgcataattctgacactgactcctctgcctccaatttaaagacccttattattacattaggctcacctggataacccagaataatctccctcacttaaggacaaatgaatagtaacatcaactgcatctgcaaccttaatttccctttgccttgtagggtaacatagtcatcacaaggttccaaagaataggaactagtcgtgatttggagtgggatggtcagggccattatttggtctacccacaaccaagaataatgaaaatcatattttgctcctgcctgtgaatggtgaaaacttcaaaggaagacacatctgacactcttctgttgggagagtttattcaacttcattttgacttcactgacttctatacactgatccaaggtgtttttttattggcaggttggatttaattttcaaaagataaactgcttgattgcaatcaaaatcaaacagaataatttatgaaaaatggaagcaagaggagaaagaatgtaggaggaggtggacattttccaagtgatttaattgaatattatcttaagaatttctgaagctcaaattcagaaggacacgtctagttggctaaattaccaagtctgagagtaatgaaagagttgccattccatgagcctagagagcaaaccaaactagaaatagcaatctcacttatatatcacagaatttcagtttaagcataggatacaagactaaatcaagctttaaatgtgaactctgtattcactatgtaaaccttctaacggaatagccttcagtgtaaagagctagttggccataaataagtttaattcccttcctttaaatttagatttgactcaagctgcatgaatttctggacagagaaaaaataaatttggggcagctagctgttggttttacagaattaattccagtccagccttgtaatcgcatatatttattaaaataactttgaaataaaatgtacggggtcaaaaagtatcaaaatatggtgactttaacatggaaatttaaattttaaaagaactatgtggaaaaattaaaaataagacatattgacaatacacttaatcagacagatttgtcttgatactaaaccctttcagctaaactcaatgccctccttctagctcttcttaaagtttcactcttcaaacaactactcagactcaaagtacacccccaaattcaacccactcacacaaacctgacttgatcatgtaaaatatcctttccgctttagctgactaaactttaaaaccaatctaagcacctggtgtgtcagtgataatgaacaatagtgcatatggcctatagggagttagagttgactcctaagtgagtaactgcttgccactgacatacaaggacttgaatagctctgggaacgtgcacagctctttacttgcagagtagaaattccaaggattctacatctttcattttgattacagtcgacaccaaaggcattcacacttgagatactgactgtcctgattctacagttctttaaagtgtctcaccaaaataataagcaggcttcctgatgtcttttctttattcacatgacaaaggttgaatatcgtggttactgagtggcagatattgagataattggtgtctcgaagcacataagggttgctgtgcttgaagattttcactaaattagtgcttaaaagataacaaataattgtaatataacatgctgcgtgttaatgcagctattacataatatagactcaacgagaagataactaactttactgaacgaagtcaaagacaggtggtagcacctaagttgaatcgtgaaggataggtagaggtttgacagaaagaatcaagaaggacaatataaacaaatatgaaagcaatttccaacagacataaataagggcagtacatttgggaagctcaggatgtttttatgtggctggtatgaaaggaagaaataggggaacagcaaaagacaaggctggaaaggatggctgaggagaaactaggaagagcttacttactgtcactgatgaggacttctttggaaagtcatattctcagaagtgttaggaaatcataaaagaaacaaaattttcaactgaaagcatttgattgaaaaaagaccttgcttgagggcgtttatctttatctttgtgaggtcaaattttgctaaggatggttaagatggtaaagtcagcacctgatacagaagatgcttgactacaaattcataatatatctatggtctccctggaccattcagttttaatgcctacagaaccagtgtggaacaaaaggtacgtagacctggtgaaaggtcacacttgtttattgtaagcttgcctttgttgttgctatttctaatttcaagtaagaaacaagtttccagacctcaaataaggagatataactggtagatataactagtagatcttctcaaaatgacattaacttctttttgtaaactcctacttcctcatagtatagctggagaaacatcttaccaatgtggagtagacagtgatatcttaatagcagaaatgtctcacaatttgattctttattggtgtgaaacactgtatcataaaaggtttcgaggccatatccttaagaggagtggtagattttcaatgaaagagctgtttagtattttggaaaatgcaacttctaaaaccagcaaacaagtatcacaaatggtgatgatgatcatagcacccttggcaaatggcctccagagaaccatcatagctggtgaaatggatacaacatgattaaagagaacttccatcttttctttctgagcatttcattataccactgattctcaaagagctggccctgggaacctagtgaggtctttcccagtaggatacatatatatgcatatctcatatattcacatatagtagttatgcatatactactgatatgagtgatagggacttctctagatcccaagttaacttcctaatagtagaaaaggcactacattgatgtaatatataatgcccagtaatttccactaattctagtgtttgctttttttgctggattggtttgacatgtgaaatcacacagaataaatctaatctccaatctccactttacaatccccactccatgacactcaattactttaaatgttttatcctctactccaaagtctgctgttttttaaagacaaaaatcaaaccaaataaacataaatcctaattatctcacttttctataatagaaaacttacaaagaaatttcaaacaaatggaaaagtttactttatcaaagatctcctaagaatctgtaatcattctctaatattaaaatgtttggcacaaacatcagaactcaaatatataatataaatcctggcaaacaactccacaatatattgaaaaatccacctaatcatttgatacggtttggctgtgtccccatccaaatctcatcttgaattgtaatccccacatgtcgagggagggacctggtgggaggtgattggatcatgggggcagtttcccccatgctattctcatgatagtgagtcctcacaagatcatggttttatatgtgtttgactgttcctccttccgacgctctcgctctgtcttgcctgcggccatgtaaaacgtgcctgcttccctttctgccatgattctaagtttcctgggacctccccagccatgaagaactgtgagttgattaagcctcttttcttataaattacccagtcttgagtatttctttatagcagtatgagaatgaaatcatatatgtttaaccccttttttttttttttttttttgggacagagtctcactctgtcacccaggctggagtgcagtggcgcaaacttggctcactgtaagctccgcctcccaggttcactccattctcctgcctcagactcctgagtagctggaactacaggcccccaccatcatgcccagctaatttttttgtatttttagtagagacgtggtttctccgtgttagccaaaatggtctagatctcctgacctcatgatctgcccgcctcggcctcccaaagtgctgggattacaggtgtgagccaccacacccagcccctaaacctgttttttttttttttttatggcaaattaaataaaaaactttaagtcaaaatgtgtgaaaagattgcagacaaccaaactatggcagaagagtttgatcacatgataagcttactctgaaaaatagttttttaaaaaacaagaaggatcagccaggtgttgacatacaaaaccatatagccaatcaaagcttatttgaaccatatacctatgttgagagagacagtttagaatttaaatgccatacaggggcattcagtgcttagagggaaaaaaattagtactgcttttatctggatataagccatgagtggagaaaaacaatgtacacacatgtagactttatatatgtatgtatagtcacataatctttcatatatatgtaatataacaaaccaatgtctgggaaagttaatggcaacagtttaagagcatcaagataaactctttgtgcttagaaagtttagttttgtcttaatgctattcatgaagtgcatcgaaaagttagtttaattcaataaacactcttctttagaattatttactaagtttactgtattggaggtcataataatgaatcagaaggtgctcttgttttcactgagcttatagcctaattaataagaaaaagtaatgatgcgtaatccatgtgtgttgacttttaaaaattcctgctctatgtgtctctctttaaaggtgtaagttagtatgtcttcagtaggctagacacttatcttagttacccacaacagatgcaattctatgttgtgcctatgccattgtatatcgctacaaatcataggttaagttcctggaaggaaataacaggctgatcaaggattttcttaaaagcttcaatatgtcttaaaggcacaggtatcagagattctaaacatatttatctttttcacaaaagtaatatatcctatttgataaaactatagaattcatagtaatgcagggtaatgtgaggttcaccaatcattgtaagatataaaatacaagaaaaaataatatagtattttgcatatcatgaattatcttaatatgaaaataatactccatcacataaaatatatggattttatggattatatggattatatggatatatggattatatggataaatatacgcatttataatacagtctcaaaaataaattagcaagtggacaaatacaataattacttttaaagcactctggggaagatctgaaaaaaataaaaaagatgcttaatatactacattatttaaacaaatgtaaattacattgagttcatggttctatttatgaacttagaataagcatcgttaacacataaagaaaaaaacagacgacaagaggcctgcagaggagcagaaacaatgcggaaagtgagaaagaaaagtccagttattttgaaaaacaagactggtttcaatattatcatttggccatcttaaggaactgcaggttaatcaatacattataattgattaaaaggaagtatttacaatatatacaatagtactaatatatttagacacataaactacatttaataaaatctgtgttaagagtcctaaacaatgctataatatttaatccttatctaagctaggcaacacaaagcaacaatattgttgataaacagctttgctacataaggtattgggaaactaagtaaacttgtgatagctttggtttttaaggtgctatggttggactccatttgacacatttaataaatggtgcatacaatttttagctaaatatctaacaggatgtcatcctaaaacctcatgttcctatattactgtgctgttaacagaaacagcttgcagagatttatggcttctattaattacactaaaaaatatggtagatttgctcaaataaatcaattgtaacagaaaaaaagcgcatttttaaaattacaatcatgcgttacaaatgactgccattatcaattctgccttttcatttattcccaaagtgaagggttaaagggggaatctttctgttttcctagatttaaccctggaagagcagtctttgagttagtactttaaatagcttacagggattctagttaatagcctcaaaaattggaaagaaatgagacaaaatatcaagacaagaataagattgaaatatataaatttctgcctatccctgtttttataaagtaagtttcctccccttaccaattatgtttcagttctatatttccattcagtgctactttggctttttttaaaattattcatatacctgttaatacaccctccttgttccacaaagaatttaccaatctttgcatttatacaaacaataaaagcaaaaatatcaaaataaaacaaaaaaaaggagaaaatatttttacaacagtgaaaataaaaggaagaaggaaagatcaaataaaaaacagaatgcattcaagtttacatttagaactacatttcagatttctgaacactttttgttgggctctaaatcaatatcaatttcatgctcactgatgttcccaaggagttgtgtttctttattcaatatggccctgaacactgtgagccctagatgtaacttatattctcaaatacttatgtggcttggcattcatacagaatctgtctgaattggtaaaaatactcagatttgttttttcactcttcattaacctcctatgacaagtataatccactatcccaaatatttattattatttaaaagaaaaatgtactcatttttcttggaccaacttgtttaaagacacaaaggactcatcatcctgaagaaaattacaaatgtattaataactttttatgccatctataaacatctctcattttggtactaaagaagataggggtctttttatccccttactagttagagaagagccaaacatataaatatgcatggagaaaagcctgagagaacatctaccaacatgtttacagtatttatctgagtcactggatcatgattagactttcatacattctccaaattttctacaatgagattattgttcaaaaatagccagtgcactctgggaggccgaggagggcagatcacctgaggtcaggagtttgagaccagcctggccaacatggtgaaaccctgtctctattaaaaatatgaaaattagcccagtatggtggcatgctcctttggtcccaggtatcccagttactcgggaggctgaggcaggagaattgcttaaacccaggaggcagaggctgcagtgagccgagatcatgccactgcactccagcctaggcaacagaacaagactgtctcaaaaaaataaaataaataaataaataaataaacaaataaacccagcatctgaaaagtatcaaagtactgaaacaataaaggacatataatcagtcaatatgaaagcataatatttttgacccttagaaaacaggctaggaaaatggtctttctatcagatcatgccttttaacacaagcaattatttccaaaaaccaatcaaatgtacaatgctgcttatacttcatagcactaaaaagtatccttcatcatgaatgggagaggatctttcattggaagagccatttgtaaaggaaaccactgtctgaccttctcagagaaatgctgtcttccaacgagttaaaatgcttgggttatcaatctatgagccaagttggaatcattaatcccaagtctagacatttcaagacgtagaagcaaaatagcaaaagatacagagtgtatagagttctgctcctttgctggaaaaggagacaaaggttgaactttaactgaaaaatgatacggtttgtctgtgtccccatccaaatctcaccttgaattgtagctcccataattataacgtgtcctgggaaggacccggtgggagataactgaatcaagtgggcaggtctttcccaagctgttctcatgagacttaatacgtctcatgagatgtgatggttttatgaaggggagttctcctgcatacattctcttgcattccaccatgtaaaacatgactttacttctcatttgccttctaccatgattgtgagacctacccaaccatgtggaactgtgagtcagttaaacctctttcctttataaattactcagtctcaggtatgtctttattagcagcgtgggaacagactaaaacaaaaagtaaaaactgtctatggccatatctgtctatatcaccctgaatgcaccccatctcttctgaaaagtaaaaacaaaacaaaagtcattgaagcatcagttacctatggaacatcttgtgtttgcaaaactgatgcaaacaataactctggagtaatgaatttttttgatacttttttttcttaattcaaaagtagaaagttacaaaacacaaaattcacagaaaacaaaagggggaacgcaagatggatgagggctctactgatggccctttcccccacccgcccaccctttttttttttttttttttttttttttgaaacggagtttcactcttgttgcccaggctggagtgcaacggcgcgatcactgcaacctccgcctcctgggttgaagcgattctcctgcttcagcctccttgagtagctgggattacaggcgtgcgccaccacgcctggataattttgtacttttagtagagacggggcttctccatgttggtcaggctggtctcaaattccctacctcagatgatccaccagcctcggccccccaaattgctggaatttacaggcatgagccacggcgcctggccggcccctcccctttggtagaaaccaaaaatcaagtgagcactcgcagtgcctaattttgatttcatattgttgaaagaggcactgaagaaggtagaaaagacagtggtgaattgcccacgctgcccctcccccatcccctggctgcagcctggtagtgtaaggaatctatgtgcttgggatgggtggagcacagtgaatgggaggctttcatccaactcagtgctgccctctcacagtggaaagcagaaccaggctgtattcagccgacacctgcccatggagggggcatttggactggcctagccagacggaggggattgcccatcccagcagtcagagcttgagttcccacaagcctcaccatcacaggctgaagcactctgaggccgtatgtgaactccaggggcagtctaggccacaaatactgaaattcctaggcaagtcctagtgctgcactgggctcacggccagtggactggaggggcatgtaacctactaacactccagcctgggtagttaagggagtgcttggatcacccctccatcaacaccaggcagcaaagctcacagctctaaaagacaccctttccttctgcttgagaatagaagaggaaagagtaaagaggactctgtcttgcatcttggatgcccacacagccacagtaggatggggcactggtcaggtcatgaggtccccattataggccccaggtccctgatatttctagacacatctttggccagaagggaacctgctgccttgtagcaaaggacccagtccaggcagaatccagaccctactgactaaagagcccttagtccctaaagaaccagcagtaatacccaggtaatataccacaggccttgggtaagtctcaaacacatgctggtttcaggtgagaaccatcatattaccaactgtggtggctatggggagaaactgcttctgcttgagaaaagcagagggaaaaataaaaaagaaactttgtcttgcacctgaggtaccagctcagccatagtggggtaaagcaccaggcaggctctccgggtccccagcatcctggatggcatttctagacctgccctgggccaaagagctgatcgccttgaagggtgagtcccagtcctggcagccacaagctgactgaagagcttttaggccttaagtgaacactggcaggagcttggcagtactccctatgggcccgtggtggtggccatggtgtgatgttcctctatctgtggaaaggggaccgaagagtgagaagcactatgtcatatggctttattgccagcccagccacagcagactagaacaccaagtagacttctaaagtttttgactccagtccctggctcccagatggcatctctgaatctgccacaagcctggcagaactcaccacccttaaaagaaggcctggatggctttgccacctgcagactgtagagccctatggccttgagcaaacatagatagtagccaggtaatggttacagcaggccttgggcaagactcagtgctattcttgcttcagctatgacacagcatagtcccagtggtgatggccacagggttttttctatgacctcacccttggctccaggcagctcagcacacagagacagactccatttgtttgggagaaagtaaggcaagagaacaacagtttctgcctggtaatgcacagaacttttctggagcctatccaagaccaaaatggcaaaacatctacaagtctccaagaaccactgtgctattggggttgggatgctactgatggcagtattgtttttcctactgattgacagtgttgtcacagagtaaattcttaaacgaatagcatagaattcaaatgatcaaaagcacatattatcagggttggaaaaggaaaattagaaaaccatacatttattaatttagtcagttaagaaatatgtatcaagcacctagtcattgtgccagattggggaatctaggtacaaaaggtacacaaccagcctggaatggacctccagtatggagatgaaaataattataggtagtgacaatggtgacccaatgtagtgcactgcaaggacagaaaagggtagaagatatcagatctccatctctacactcagtcacttacacttagcaatgtgctaccaaacagaagatgaaaaggagggaaaaatggaacatgacaggaactccctctgcatatatttacaggcacaatgtccaataaactggtgaaagaaaagtgtttctataaacgaccttagcattctatctttcacctgagccaatagttctaaatagaaaactgtgaacatgttttcacaattaaggtgtttacaattacatctatctgtaaagacccctagatattgctggcatacaccttcctcattgcccagggcttctgagacttcacactaccttgtctgtataagcctttggtggtgcttcttctctccacttataaataggatgacaacagcaactgtgactcttgccacatgatataaacttactatgagccttatcaggaatgagaataccagagaccattgtttcatgagatgatgaattccctaaacgtgtaaaaagacaatatacaaacaaatatttaatttttaaaattgtttttcaaaactgcagcaggaatcagcatgtttttatctgacataaaaccaaaacggccttcaacatctctttgtaatagtctcatgtgctcagacactacagacaatcgtcaatagaaaagactgtcaacttgaatgaactcaacctgcatcaatatttttccagagtcagcaccatgcccaaactaagagaaacatgcagttacataaataaatgaatatggatgcatgtgcatatatatgcatttgtatatacacaaaatgaatgtgaatatctttctatatctgtatcctagctttaattccatctccatctctatgcacctgcatatactcattcaactaattcattcatctgcataaactcattcgatataatcccctttagtcaaacccaccactgaattagtcttccttagactgctgccactggaagatgaagagattccaacaacactgcaaaaaaatatagcaactaaacctgtcttaatcaatttttaggtttcaaacagaggttcttaatcataagtagtattctattacctgcaagatgatttgtattcatggaagtatactataatccttaccagaaactaataatgattttaataaacttgcattgacttcagaggtttcaccatttataagttgcttaattcagtctttgtaaaatcattcattactctttacagacatcagctggggaactacaaggcaattattagattaaactggatttaaaggttgcttttattgtaattgcaaaagaaaaaaatctaagttttcttaaatattatattgtacttagacaacagtttaaactcttggtgtgagtagaaaggctgggtctttggccctatagacagctttctccagtcagtggtttcaaaagtatttactttgtaacactggagctacatctccttaacggtttgctttctcacttatttgagaacttttttcctataacgtgaataaaaagaagaaccttagcaccccaagcaccattttttaagttaaatacttcctttatatgagaagcagatgctgtcaatagaagtcacccgaattcagcaagcagttagacgattaatcaacttagaatataaatccaactatagttgttacttataagggaagttgatgaaaagtacatgtcctaactctcctatccattgatataatcaatctatcaataataaagtattaattagaaatattttcaggactttggaggaaacaaacaattatacattgcttccacatgcaaatatttcacaatttagttatagtgaaatcccttaatggaaaagcccaactaattagaagaaaggctacaatgaaaacatgtactttgtattaaaaagcattagacactataatgtgtttcctatcaaccatgcctcaaagtttctcctacctgtcctggaaacacaatatagctattctcacaactacatatatccaaaattaaacaattatgctgagagtgtttaattcttcacttcagcttccagcatatcatactgtcaatgaattaacattcattgacaatctactatgtgcccagtactgttgttgtaaagtaaggaactcaaaaacaagacatagtctctaacctcaagatcctcccaggagaggaggggagacccatgcatgaagtaaaacacaatgctttaaggtatagtcgaggaaagagcaaagtgccacagtggcacacaagagaggaccattagatctcagaaaatagccagggaagtaatatatgagctagatctttttcagaggaatagatttcccagtaaacattaactggatgaatcacagatagggtgggaaaggaagaagacttactaaggcagagaaatacaagcacagcatgatattttttgagtggaaagttcagcctgacaagagcatgaagtacattacatcagataagggtaagtccaagatgaggccagcaagggaccctggccatactgcctcagggttttctcctatagccactggggaatgataccaaagtggacagtcaaggaacagatgccaaaacccttgcaaaaatccccaaagcaataagggggactcaagctaaatcagataaatatagcatgaaaagaggaggtcaaatttaagatgcatttctgaagtaatcaattatctcctaagctattgcctactgagtttggtggaataaggaggaaaagagaaatcaagtaagtctgtgagttttcaggctttcataaacgggtatgatgatgccattaactgagatggaaaatatagaaaatgggagagaaaataaggtcatcccttaacatgtatagcctgagattactgcaatacatttaggtgcaaatatccagtgaggaggtatgggaaagtaagcaagttattttccatgcaacttatttaggaacaatagcaatttgatttctgggttttccatttatttaagtaacaaaacaaaaataaactgccatcttttaatctattagttgaatcactcttggtaacctctggcctatcaaactgtgcaactgcccatgctcccaacccaactgccacaaataaactcttcttctatcaacctcttcagcaagaaagcattttgccaacataatatgcctcagcagaccttaaaataatgaagttggaaaaatgtgggtgagcaaattttgaagtatattaaacctgacaatttaatatttatgtaagctgcaagtgctaagcataattggacttaactattggcttaggtttaatgggttgtgaatttaacttcattatcatagttttgcctgctctttgagctcattcaaccgaactagagaaaaaaaactgagagccattttctacctcaccaaaaccatttttgagatgacctgaaaccattgggtcaaagaaggcggattctttcatttcacaaaagagaagagcttcagtgaagactcctcagtggttacagtcagaaaacaaacatgggtttactctagatgggctagttactgtgagtctttaggcaagttactaagcctctggaagcctccatctctacataaatagggataatataaaactttcaagatactgtgaggatgaaaggagaatgtacctaaatcacctggcagaatgcttttgcacatgatgtgacatcagtgcacgttggttcccttcagcactcatgccattaccttgtgcttcaacagacttacaccacttccaggcctttctgctcatctctatggaagttggcaacataagcatactctacttactagggattgatcatcctaccagctattacagccacctctctgatacgatttgtagcatgtaaatcagaagcacaggtgtgccacagcatggatgagtcctttgggtttttttgtttttgtttttatttttcggggagcgggggtgtcgaggggtggggatgtacatcgtatactatatcatcctaaagaacctaaactaaaaggatccttatttcattccattttatgctttataagcacaaaacaatgaatggatctacatacaattgtggacaaaatctctctgaaggcatgtctccaggaattcctttgtggaatgtagtgatgaggaaaggaggaaggaggttccaagggaaggaaaagaaaggagggaaaagtgtccaaataactgtctttacatgcattcacaaacacacacacacaccccctcacagtagccaataggcatgattctacaattagagaatgctaatgtaatgccagtatgccttgaggaagatcacagtctagtcctttcatgtggggaagaaaagccaagagaaggaaaatcaattacctgtgaatagcatcttacaggggcctctcaacctaacaaatgaagagacatgaagcatatgcagagacatacgtttcctatgtgcaagcatcaagaatccagaccatatgatgtataaaagagatgaaataagttttcaatttatttccagggagtaaataagtaactgttgaaggagggaaaccaaccccagatgctatttagggcaccaagctttacttcactacatgatgcttgatattctgaaatccattctgcctttctccctttctcctaaacacctccaccccttctgcacatgaaaacaatgctaaacagtcttttcatattttgtttatattttatgctagaggaaggtcatttttatatctatacaataatctctctcacctccttagttgccacattttaagttacagaaactttattcaaaatgttcacaaagcacattgcttaaattataaatgaatccaggatctgtcacagttttttttgtgtgaccaaatttgggcatctctctctgtagaagcaggacaatagtcttaggtaaagaaaaccttacttgaatgcttaacttcaacagaagcccaatgggggctggagcagacacataaatcaatggtagaatgctgactacctggggctgcagggtttggaatagttgggaagacattggacaaaggatacaaaattttggttaggagaaacaagttcaagagatctattgtagaacatggtgagtatagttaatattatattcttgaaaaatgctaagagggcggatataaagaattctcaccacaaaaaatataactaggtgagttaatgcatatgtaaattagctaggtttagtcattccacagtgtatatatacttaaaaacatcatgtacatggtaagtatctacaattttgtctattaaaatctgtaagcatataaacagcaaattaaaaaattcataaaataagtaggaatagggccgggtgcggtgccgcatgcctgtaatcccaacactttgggaggctgaggtgggtggatcacaaggtcaggagtttgagatcagtctggtcaacatggtgaaaccccgtctctacaaaaaatacaaaaattagctgatcgtggtgacacgcgcctgtaataccagctgctcaggaggctgaggcaggagaattgcttgagcccgggagggagaagttgcactgagccaagactgcgccactgcactccagcctgggagactgagcgagattctgtctcggaaaaaaaattaaaaaataaattaattaattaaaaacgaatgggagtggcccctggttataatgccatttgcaatggagaatgaccatctcctactagagctgccatgccaaacctcgtggagattcatagaatagtcacttaataaataaacacaaatatttattttattacagtttattgcaaatctaggatatataattttaaggcaacctagcaataagtttaagggatgtttttacattatggtggactttataggaaacaaatattattcttgtgtcacatgtttacatgtcaaatataactctattcaagttaacatggaggctgcctgccacacttgggctgcaaacatctgtgattacaggatgtcagcttttacgacgcactgcattctaatccgataacccagtacactgtttttccattattcaattccgcatatagctgagaataggacacagtatttctaaacctttttttttttaatctagacttctgtataggatatatctatacattacatattgaattgaagatattactgttaccctattaacccggataatacaaatagttgaactaattcaagttccaaagtaaaatttcatgacttggatgatccagttcagctgtcatgaaatagggatgaaaaacggcacattataaaattttagtaaagtattttgcttatactacaaaagggccagcatatggtattcctaataaagagattagataggaagaacgagaggtatttccaaactctagaatgccacttagcaaagcatcactgtggtatattttagcgctccctgttcacccagcagagcgctcaaatctaaagcaactggtatattccaagagagtcacttagaaccactcagagactctcagtgtctctcccatatcttcttatggcttgacccatcccctgctccagggcagcagggaatctgaatctgaattaactgtccacatatatcaaatcagccagaatactggaaaatcacggcgtttagtacatgaatagcagttgccattagagtactgacggcaaatggatgatgtaaacagaactttgaaaatgcaccgaaaaaaataaaaaaggaagaatagaagtactcctttaattttcttaattctggaggggtttatggaaatttctcttcagggatcttcatgaatcgggccatatgtactttatctctacaattgggaaaggataagtggcccaaagagagtgaatcagcacaagtcaagtggttgaggcattttgcagagtgatgagactcagacaggacttcgcaaagaagcaaccaggtgaaaaacaggcttctcagtgtttcccacatatcacctctataattcagaggaccagagtcatctgtgggcaaagtgcagcacaaccatcaacaaaaacaaaattctcacatcttgtctcatcttaaaagtgaatgagaattttacgtttgtctcctcaatgaatgtaattttaatattaaataatccttgttttccttcaatctctgagaaaagctgatattccgggaagatgagacatattaactttatcatttcacatatgcttggctgcatcccaggacttgagtgtgttcacgtggcagcactggacagggtgtttaggaggtaactccataaagggcagcagcacagagcataggaaggatatgggatgtgaagtcagtttcttcaaggtcaggctctgtttcatgttttgtggttttgtcatcttttcttacctttattttagattgatgagttgtgaaaagcattgcccttatgatagaagtatcatgaaaataaactaaattaatatgtgacaagtatgtaactggatgcctgaatcaggtggatgtgcattccacggaagcttgtgttaccatgtgaagatctctgctcatccatacacaaaaaccacagaacaggagcaatttagcaccactcataaaacagggcacttaaagagtaaaattaaataaaaattataaatcaacacaaaatccacatttgaacatcactatttaactcaagtttatttttactaatagctggttataggtactaaattaccctgcaataaatgatttgctcataattcataaaaatggaagggatacttgagtattttgaggttttcccttaatcatttgactttttccttccttttaaccgtattttttccttatacaaataatataaaggagaaaaaattcagtatatttcctacattaaaaactccaacataaatgttgaataagacaagattagattcatattaagttctgattacgagctgagctactaaggctcactgtagctcaggctccctattagtaaagtgggagaactaattttctacctatccctcaggactgatatcgagattaaatgggctaacctgtagactaaagtggtttaagagtagcacacattttaagtattttggcatagcagcacactttttgttaagtgatctttatcatcatcattattatttgttgttgtgcaaacactgctctttctgaactgcagtgcacccatctatttcaaagagataatacttcacaggattgctgtgaaaagtaaaacacatatatatattttttgtaaagcacttagcatactgttcggcacatattaaatactcaataaatggtggctattatcaatttcagtattcagaggaaaaaatctgaggcactggaaagcctagggtttttgttcaacattacattgctagttagtgtcgattctgggatgggatcctagtttttctggtgcccagcccagtgtcccagccacaccacatggtctcctatagatacctgaatccaaactaaaaaccaagggctgatgcttctttcctctctgttagacaaatgaaaacttaaaccattctatttgaacagcaaaaaagctgcgaaagtcaaggagtgggcatgctaagcaccacagactgacctttaaagtatttactcataaatattcagttcaatagccaaatgccagtcttggtgcaccactgtggtttcattcactgtttgaagttacagggacattatttcatccagtctagttctgctgtgttattctacttagtttttagaagagctttaatttcctggcactttttattttccatataatcatttcattaaaccatacaacaggacgtgatctggtttagatgaaagggcaacaacaagccccagaaaaataactttactagccagctgctaacatgctgaaagtaagtttttctaagcctagctaattacattaacattttccacatcaacaaccattatggttttatattttcatgttgaaatattatatggtcctccatctaaatttatggtttattcttttcataaatactaggatactcaaaacacgtgatgaaaaaataacatatccaaaagattacatttcttataatcactaaaatagatgtaattccttacttttcacaactgagaatgtttttcttaatggtatcccctgtaaagtaagaaaataaccaaaaagctgattgttcatttgttaaacaagaatatcaaagttaaatgagcctgactctgttctaatcagaggatatatatttttttaactatcacaaatattggtaggacttgccagttgggcaaagctatccttatgatgacgtcactaaaagatgaggaaaatggaagtgaccaaccagaacatggggtaaaggatggaaagaaaggggaataaaaaccagagcagggccaggcgtagtggctcacacctgtaatcccagcactttggaagcctgaggaaggtgaattgcttgagcccaggagttcgagaccagcctgggcaacatgacaaaaccctgtctctacaaaaaatacaaaaattagcagggcatggtggtgtgcacctgtattcccagctactggcaggggtcaggtgggaggaccacctgagcctggaaggtctgggctgcaatgacctgtgtgtgatccagccactgcactccagcctgagtgacagggcaagaccctgtcaaaagaaaaaaagaaaagacaaaagaaaaaagaaaagaaaagaaaagagaaaagaaaagaaaggaggggaggggaggggaggggagagaaaagaaaaaagaggagaggagaagagaggaggagaaggaaagagagcaggaatagcattcattatcacttccagaaagatgatgtttcaatgttaactactcctttttgtacctaaatatcaagaccttgtgaaaagaaaagaaaagaaaagagaaaacaaaagaaaacaaaagaggggaggggaggggaggggagggtttgggaggggagggaaagagagcaggaatagcattcattataacttccagaaagacgatgtttcaatgttaactactcctttttgtacctaaatatcaagaccttgtgaaaagaaaagaaaacaaaacaaaacaaaacaaaacaaaaggaaaggaagcaggaatagcattcattataacttccagaaagatgatatttcaatgttaactactcctttttatacctaaatatcctacaaaacatatctcctttacacgattcatccagtaagtatatttatatttcatattccattgtttgcttttgtatgtttggccatatcaattcaaaagcactgaaaaatgttcatttcatttaaaggccaagattaaatgtatgaatttgagtctataggcaaaggatacaactggcagctgtacctgaattaagtggaggtgtttgagtgaaactgtagatagatcatttgagaggctgtacaatggagaaaggaagctgttcaattaaggtgttagaagcaaatcggaaggtaaggaaaaacacaagggtcacttgtcagttattacatgggaatgcattggtcagaagaagcaagacagaagaataagttaatgaaaatccacatgcttcgaacttggacacagggagaaggatggcggtactattgactgaaataagaatgcagtgttttggagggatgttcactgaggtgagaagaggatgacaacttctgggggaccctgaggctggtgggaccacccacatacaagtggtacctgcctcaacttttctccagtagagaacaatgaagacatttcacattcttttttatgcaagactattagcatgttttaaacaattgcctctagagtgattatttaaaattataatcgattagtttaaatcatgatgtgttctgtgattgggtatggcattgttatgaactactaccgtgccttcagactgattaggtattaaaacttacaaaaaggaaaggattattaataacaccagtagttagtactttcatgtgtttatattcaacattctgtcaataacaaaaccctaacatttattcattagtaaaaaaagacttatattttacttatatttggtgtgcgtgctgggcaaagggtaggatgtcttagctctccattacttccaacacataacaggtattcaaagaatgttacttttgaatagactgaataacaaatataaaaaagcacatgtagattaagacaaagttactctgcaaatgttttaaaagagaaatggcattctttcatctcagtggcctcttccatttctagaagagagagcaggaaggggaagggaaaggtactatccctgacattaatgctaagggtgtaaacattataatatcttactttgccttccttctgggaaacagagcacttcaaccatatctagaaatacttgagagactattctgctactgacttattttttttaaaactaaaaataaatccaagtgggaataaagggcagattaaaatatcatagcatcacagactctctgacatcatcatgctgtgttttttacccaaagtttgaatctcctgcctctctagcacccccagaaaatgatcactcacctctacctcctaaaattgccctggtaattttcaggaagctgagatcattccagagttcttcctgggaccaatccaaaaatctgccactcgctgagcctgatttggctgtctgcatgaacacaaaatgagtctaatccctcttctacatgacagtccacagaggcaaccaccagtttcataactggtttagttgtttttcttacaccctgagggaccaggagaattacattttcacattctcagcccaactgtcttttctgcaagaactttcctaaatgaataaatagtctgtcattttagaactagctcttatcaaagaagagtatcgctattcttgcagttttttttttttctataaaatagtaaagttgtgtccttcacattatggtaagtctgggaggctattagtgagaatatgagtttctctagttttgttctgttatttgatatagtgttatttttaatatactgtcattcagatgtgaatatgacatgattaatacattattggtaaatgtcatttaagatatgcttccaggagaagcaatggtattacactgagctttttgaccctcattcttcatatttgtgaattcacctatttgctaaagtttatttgtaacctccaagtcaatacttatggtgatttcagccatttcatacagtggcaaaatatttgagttgcccaacacatgcagtcacagctaaggtcaaacaaggcaaccagtttatgcatttgtggcaaatgagactaatgagttcagaggtttgatcatcccatgaccaggtataggtttattcatagtaaaagacctccctgcctgtattcagtttgataagatgccacacagattaatgctgaatgttgtaaggaaggccaggataaatgagggtagactgaaatagagaagataatcacttaagtactctttaggactgagtcaatttcattttccttttatgtagagccctacaatgtagaatcctacagcttctcatatctttgcaaagataactactacaaaggagtttatgcaagaaataagagggcatataagggatctggcacattgggatcttggacctttagacatgagacaaaatgacaaaatgagacaaaagacatgagacacaagacaaaatgacagacatccggtcactttcaggaacaagtatctgttagccaaagtctacgacagagttggacaattacttagccctgactagtcctcatatttcacaaaaagtaatctacatatggcaagtaactccaccaaggaagagggcttcctattttcccactttctgaactaaatcagctcaagctacttttaaagaaaggagagcccactcttgagacttctttgctccttcttttgtttggcctgctaattctttctccatctgaggggtgagaaagacttctttttagctgtctctttcactgccaacctgctttgataatgttctgggggctttaccagaatgacattttagaccactctaactcagcttagccactgaagctgagcacagctgaagaaagcactcaattagcaactccaacttcaaaggctatattattctctcctcaatacacatgtgtaactcccattagcgttaatgggagctgtgggagcccacggctcagagaatatacctccaagtctgtttgcttgatgagcatgcaattaaaccttatggcccaaatttttcaaggagggcatagtaagtacaccaagcactcatgcaaaatcaagtgtgcttactttgagaaaaagtaagctatcgccactatttaaacatgaagaaagagcagtctaaattaggtctattttaatttcatttgtcctcttaggtgtggacaatggcctttcatggtgttttgaggaaagtcactcctcttttttaaaaggtgaattatatgtttttagaagcattagttcacattgcttaaaagactagctagcctcaagggtaaaaatgtctaataagaacaaaaccattctaagtgaatttcgtacacataaaatccagcatggcacctatatacactcagtggcttttcctgtctttatttaatagctgtattctaacttaaaattaggaaaaaaattgatttgacattaaaaagaaaaaaaaattttgagaggaaaatgcatgccccaataataaatttgtccttatcaggaagtaataatttccgtccctttcttgcattctaaagagatttgtccatatattttcaacatgaaatcaatatatatttcagcttcaatgaaatatcaatatatgtcagctagtctgtgctacagccacagtcttgaacaacatcttcatggggaaaataatcttgataatttagtaccatttaaaacaattccttttctattattcagacattttccccaaaatttaaaaagaaatttatgaatgaaagtttttacattttataaaggagagttagctaatcacttttaaagtcatacaagtgaattgttgatctactattgacacataattcactctaccaccaaacctcatatcctgactttctaaccacatgaggcttttttaggtactggaccatcagtacaaatcaattgaagtgcaacgggccaatgaacttatcagaaagacaaaagcgtccacactaagcttatgggaatgtcgagatgtcaggagacttttcaagttgtaacatggcagatgagctagaggaaaactcctttaaaatttcatctagtacatggtcttcataacttcattttgcactaaatatttaacaccttgctttacaagtttgataactaccatgtcttcataaaatttcaaagcccatgtgttaaaggaaagaagtatttcaaaactgaacacagggatcccttacttcagactctaggcagactgaataaagaatgataaccatagattagataataaaccgtggtctgtggttaacagaatttttaatgatgacaaatgtgagaaacattcactatttcttatcaaaaaaagattgtggtttttctctcatatctgcaatcttattcataaagttgaaagctactacaatagataccctactttcagagcatatctcacatacaaaactacctttcaagtgagagataaagactgccgatgttattacagaggggctagacagttttattcttagatgttttggatgtgatttactctggctaaaaatactaataatttaactatgctattaatcctgctgaagtgattatgccctccatgagaggctaagctgaaactcatccagaccttcagttggcacagaacacactgatttcctcatatagaagttcagttggtagtggtttaatcggggattatcagtgtataaaatggcatttattcgaacacccctgtgagtacaaccgtactctactttctataactgttgtccaaaatacttatttacaaatcctttttttcccaatctggctcttctataagagataaaaatatattttcatttgatataaaccaaaatacactgagagttcatgaaccttggatgggtcaagggatgtgaagtaaatcaatgagtaataacagcaattacctaaaatacttgcagaaagaaggaagagagagaagaaagatgggaaagaaggctgggagaatgaagatgtctactcagtgtctctgatgagggttggtcgatgaagcacccatattatgatctgagaggcagctgagatttgtgcacttctcaggagagagaactgctgtctcattttggagaaatgcttataactcttatcaagtggatgtgcaaaacctgatgtacataagtaatttattcctattcctgattactaggctacaatcaacatcagatatgtcacttagatgtcccaacttttaaaatttactgacatgtattatttcagcaacatatttgagtcccttctctgtagcacctcttgtctaagtactgggataagcaatactgatttcattcctacttaaaagaacaaacaaaactactttgtttttaagtcttacagtcttgattttaaaaatccaaaaggcttgaatttaaagagtctaaaaatccttaaaatgaaactcttgagtagataaactttcttaaaaataagtatttctataagtgtatttatatatgtacataaaagggtgaattcaacttctctttatctttagactcttgtaaaagttgccattgaaaggcacatctgatacggcaatttcagcacagaacatactcaataggaaacaactaactagagaactaaagatgtaccgtctttgagtcttgctcattttttaaaaaaatcactaactttgaaactggtaggttgtcccacttaaagctcttgatttttaattgccatttctttttacacccaattaaattgtcagagtagtgaagaattgcccaactgagtagaactgtgaggatcttctcactgctgctttccgcagtcttaatttgcagatgcttttgcctaaaataaaaatttaaagtcacttcctcaacaataagacctgtaaagcttccaccaactgctgtttaagacagacgcaaaaagaaaatttgctgcacgagtttggggccatagaaaaaggaatattttcctatatttgtaagatatttgggttctgaataacagattaccatgtcccttaatctgatacatattaaatgaagaccacataggtaaagggcttggtacctttcaattagctcagcaagtctatcaactggtaatattcaaaaagaacaaacaaaactcatgctggactgttcattttcatgaaaacatattgtgtataaagccatgaatggtgatcaaagattcctgtgaataattttcttaatgaaagaggactaattacttgctagattctcagaccaatggtatggtatcttgacaatctccatctaccagaggtttcaaagagaaagccatggagtcataaaacaccaagacaactcagttccaacatatctgaaatgacttgccctcaccttttaacttcctgtggttgcctcaaacatttaagaaatatctttattaatttacttatttattcttgtttttagacagagtattgctctgttgcccaggctagaatgcagtggtgcgatcttgactcactgtaacttccacctcctgggttcaagtgattttcctgcctcagcctcctgaggggttgagactacaggtgcatgccaccacacccagctaattttgtgtgtgtgtgtgtgtgtgtgtgtgtgtgtttgtctgtgtttttttgtttttttttttttttttttttttttaccggaaacagggtttcaccatgttggtcaggctagtctcaaactcgtgacctcaagtgatctgccaacctcagcctcccaaaatgctgggattacaggattgagccactgcacccagccatacatttattttttaattgagacataaaagtgtatttaccacatacaaaatgatgttttgaactattatgtatacattgtgaaatagttaaatcttgctcagtaacatacgcattatcttacatagttaccacttttgtgtttgagaatactttgtacccattctcttagcatctttcaagaatacaaaacattatgaactatagtcaccatgttctacaacagttctcttaaacttactcctcctaactgaaatgttctatcctttgaccaccatctccccaacccccacccctcaacctgctcagcctctggtaaccaacattctactctctactactgatatcaatttttttagattccacaaatcagtgagatcccatagcatttgtctttctgtgaatggcttatttcaattaccataatattttacaagatataaagaggtataacaaccaaatgcattaaaaaaagaagtaccctcttaactagcctttcagtgataactatgtcttctttaatgcctttttaatgcattttatttttcacaaccattcagctcttacatcccactccaccccatctttttgtgttctcagagctctctttctacccaggttacacagaaactcaaggacgatgactaaataaatctccattacacaaccaactcagcagcccctcttggtggagttaaggtatcttttacacatcttcatccttttcctagagacccccaaaacaaaaaaaatcaacccttacacttttctatgtcacattacactcgattgtatcctttgcaagatagcattaaagggcaatatatgaagtagtaaatacagaataaactttagagtcagaaaatctggtaatcaccacatttaccagcatgtttggtcaagccacctctgaatctcagctgctctgaacttgtagcctctccagacactgcacacagaccccctttagtagtcagtaaagcacttagcagacctctcctttagggctaagaatctatcagaacctcagatggaacacctatatattaaaattcacacattccaaaactgcattgaacgcttggtaattactaattctctaggatttttttcctttgtttgatctttgcttttctaattgccaataaaacctgagcaagcaaatagaggttctgtatcatttgctcattgagaaaagaaatctgaagatcttctaatatttatcttacagacaaacgctttaaagaagaagcctaaaccattcctgccttctacctgtctcttctcctttaataaacaagacagcatgccgctcatggagaatcagttcagaaattcatttgttgaattttagtaaataatgccactagactttagagctagtttacataaaaataaaaattaagaatttatagtgtctaatgtcttgatgaaaaggttattttgcatcagtgatggtggtggtggtactgttcaaatgcaatgagaggagatagaaaccttgacctttcagaatggagaaattttaaccaggtacagtccagttaatggcggggggcagggggtggcagggaatcctgtgtaatgtgcaaaaccatcctgttacaggagagagcagtggatgtgtactgcctgtgtagtattgtatgttaaacagtaaaggaaaaaaatagtaccaagatgttctccataaatttagaaacagaattataaacattgggcaaagtcctttcaagtctatattaagccatggaggattgtgattcaggaaagacattcacccctctacgtgagactcacattcaagtgctgatgtacacaagtaatttttcttcaatcatatgtaaagtacaatgcagttcttagatcccttggccccatcccagcagcggacctagatattattaagtctaaagcttacgaaactttaaaggactactttatgaaaacaaatgcaaaaatcttatttttacaaattttagaaaaatatataatcaaccggagatactagtaagtcttcccgggtctttggaaggcatcgtacaagggagggccctaattccaaagattcctcaactgcagggtaagcctgtctctgcttcaactccacaccaattacttcccctccaccattctgagagagattttctggcacccgagtatggcaagagtttggtgggggtcttcgaacaagaattcatctcactggaggacacaggaagcgtggtccctgagcttaatcaatgctgttagcatatagttaaccaggcttgtgtaaaagacatcacatcagcatttcaccattatgcggtaaagtaattttaatttttaaaaaaaatttgtttgtttttaaataatcacaatcatatcttaaaaatgttgatagggaattaagaaaagattggctcaaaccccagtcgtactgggcaaaaccccagtcctactgggcagcatttagtgtcctccttggttctttgtactaggtttatggcaaatccttgagaataatcatttaagtcagagtgaattcttcctcccagatgatgatttatctgtttgtaagctgagatgagggaattccatttgctattgagccagtgagtgttaactttattaacgcatctttgcaactaagattaatgggacccatagtaagtcagctgtagcacttgatgtcagtttataacaagcttggcaatacctggaaattcagatctatcatcataagttataatgacatgcataaaaatttgagtgtaaataaaaggctctttaggatacagggctctaatccaagttgttcaagccttaaaaagtaacttatataacagtgttcctgttttggagtacagtatatgctaatggcctttcctcaagggttaaaatgcctaaactaccatcttctaataaataaatattttattacaaaaatcaattttgcttaatgaagtcctctgagggagaagatgttttaagacattttaccagtacactttaaaatcattttgtatttaggtatgctctgtcatctccacctagagcaaaaaagaatcataaaaaatgataagtgcagcaataaaaaactcctcttactattagttgggagagaaacaaatgggtatattactctgaaggtaattacttaagtttttttattgcaccatattttctcaaaaccgaaccaaagtatatcccaaatcttcctacaaatgaaatacaatttttctctcagaacatttttactcatcaggacaaaaaggtgagcttaattcttctgtcagctgaggcttcatgtgtcaaacacatcttacatttcaacaaaccttactgtcatattgatggaatattcaaggagacattagttcttacggcaagtactagcttgaaaaggtgtaagctgaattactgtgagagcacttttcttctaaaaatagactttattatctccaaccacagtatatatgtataactgccttgtcattttaaccaaatttatggcttcccatcagagattgtagcttccttgaaggcaagtgggggtagtttctttccatctttttattcccaacacttagcacacttcctggactagagagagctagattatcaaatgaataaattcatgaattaatacaaattgcttctcatatattgtatgcctatccgagatgtggaagcaacatctcctgacatttctaatttttaaaaataaaccttaaatccagcagtctgcaagaaaataatatttagaaactttttcctaaaacttgtcattcattcattccatcaagaaattttggctggtagcagcggcttatgcctgtaatcccatgactttgggaaaacgaggtgggaggatcgcttaagccaagagttcaagaccagcctgggcaatatagcaagacctattttctaaagaaaatttacaaaatacaaaaaaaaaaattagctgggcaagatgactcatactatagtcccagcaactcagggactcaggtgggaagatcccttgaacataggagtgacaggttacagtgagctatgatctcaccactgcattccagcctggatgacaaagtggtaccctgtctctaaaaaaacaaaaaacacaaatgtttatggaaaatgtcaggcactgtgcttactgccatgtgtacagtctagagcaaaacaaagccatgcccttatggaacttctagtctaagcatgcaactaactctgttttttaggataaaaggaaaatttcatctaattttctcttaagtatactcccctatcacttatgacagaatgatgttcaaatttcaaatattttgtggatcctacaacagccaaatggtggcatctggaccacatgattatttagtggacaaggtagcttgacttaaggattaaaaaatttgtgtattcccagccttagcaagataattctgcctgtgccaaaaagttctgcttcacaaatggggcagttccctttaatcaaataatttgaaattaactcttaataataatcctactgatcatagtaatactagtgatgataatgataatcacaacaacaactcacatttcctgagtgcctagaactttgctaacagctttacatggattatctcctgtaatcatcctcttaagtttactcaataggtcttcttatctcgacttgatagacagatgctgaagcttagagaggttaggaaatgtgcacatttgccgcaaaacaaatagtgaagttaggatttgaactcgggtctgtctgtttgctgaacctacacccataactacaccttctatcacttcctacaccaaggttggtaacagaaataatcaaaaaaacaaaacaaacgaataaacgaaaaagcaagaaaatgtttcctattatctctttcaaagtttcaaggatatttgaaattcttctgcttcttctaaaatatatctaatgttacattttcacagaaatcataaaacagttatagatttttatctagtctgtgacctagatgtcatagaacagaaataatattctagtacgacagtgtgactctagtttgagttaggcagttgaagcaattgactacctggacctacctaatgtataagcattctgaagaatatggaaatgtgtgttaacgtaacaataagcacaaatgtaacagggggaaaaaaaggaactaaaattcttgggattgtgtactagcatagcaccaataaatgattttcagtctttcaaaataacttggtaatactgtatgttttcagattgttgtatcatcctatttccttgtgaaaagctgtttttcagtcctttggattaaggactatttgagaagacacaaaaacttatttttcagagttcttcaccctcccttcccttcaccatagccacgtatacatataacacttactgaattactatgtgcctagcactattctagatgctggggattcagtagtgatgggagagccaaaccagctagctcagcttcaaagggataataaagggagaaggaaggaaattaacattctttggcaactttattgttagttactctgccagatgatttaatatgtcattaacttcccccaaaacagccctaaaagatagccaggatcacccccaaccctacagataggaatttaacattcagacttgagtaatgtgtctaaacctatacagttaggaagcactggaaggttgatacaaattcatgcttatgtagctagaaagagcatctctcttcattccctctgtttcactctgtctttgtagttctctttccctttgcctcgacttcttgactctcaatcacgctcttcatcttgcagaggccactgaaataatgactattttgttcattatatgtaaagtaagactcattcttacccaaatggtctcttaatgcattgtatctacataaccatatctatagatccctctacatatgtacctgttcatgccacaaatatctcttgggtgcccaataaatgccaggaacatttctaggccatagaaaactgtaatggagcttatacacaaaggaagaggtatacaggataaaagtctcaagacataaagagtataatttcacatagtaaaaagtgctatgaagcaaattaaacaggtcatatacaaacacactatatatatatatactacatgtacaaaacatacatatatgcaaatataccttctcaagtttttgtataaatattgatagttaataactagctttattaaaagccatcacgtttttatgagcacatacttttctactatacttaattttctagttgaccagtaaatgacagatctgcagttacccacgtaattaaacaaatacataaacaaacagaaagaactatgtatgccgatacttagaaaggtagaaaatatctaaaaactgttaatattgattttctggtctcacttatgatttatagcttcatttttttaatagctcttttggtatttatgctccaagaaatataggatctcttctgggaaaatacaaactatgatcaaattttcaacctgaatacagacatcatcagacatgtgagaaaaatctcaatagtgctacacttatgaccaaaaatctatcaattaaaaaaaaatctactgtgttaaagggtgaaaataacatttatgtaatgcatggataaagtttaataatcaaaggtaaagttctaagaaacaaaaaagaaaggcatggaaagtttttagatataaattaaaacacagctcattttggaagatgacagataagagagtcttgaaatgatatgactattccccgattgcccagtagttaaaaaaaaaaaaaaaatcttgctatctttaacaaaacatattaagaatatgggatgtgtgtcatcatagttgtgtttaatgtggcattaattcacaagtcattgtttttttaataagatataataagttacttgctcttctaaggagatacgtaattagggctttgataattaaaccctagatgaggcatttggcatatctgtgccctaaataccaataaattatgcatgtacaacttttaaaactacatcttaattagtagcttaaaataaaactaatttggaaaaccaggatactgaatttttaaaaactgctcaaattttatcaatgaaagccaaccaactacctagttttaaatataaacctcaattatgtatgaatgactgtttgatagattactttaagtgaagtattttagtaaactcctttgtaattttcagctcacataaagatggcctaggttaacttaatcacaccttttctcacttattaggtttatctccttagccaatgagtcacgtcccaacctcattttcttttactactactattttacttctgctcaattctgacctaccattgtttatacccacctgtaatggttaattgtacgtgtcacttgattaggcgaaatatctggggtgctcaaatatttggtcaaatgttatcttgagcattactgtcagggtgtttttggatgcgattaacatttaatttagtcaccaagcaaagcagattgccctccctaatgtgggcaacccttatccaatcaggtaaaacactaaagagaacaataaagctgagcctcacctaaggaaggaagaactcctcctaccttcaaactgggacatcagctttttcatgcctttggacccaatctgaaacatcagctcttcctaggtcttcagcttgccagcctgtggactagaactgcacatcaactctcctgggcctccagctgccaactttggcagatcttgaaacttcttggcctcattaataatgtcagctaatttgttaaaataaggctcttcctatatatgtatatattctgttggggttctctttctccagagaaccctaatacactgcacacacctaccatcaatactcagtgatttcctccctaagccactttgctcaagaagcttctagtttctactcctctctcaagttagctctgtctcacagactcctaaatattcttcatgccccaacccagcagtctcctcactctcacagtgtatcatccatgtagcattttacacattttgcacccatggcacttgagcactttttatttcccatcatgctcatctgtcgacatgtcagctggaagaacattgttcttccaggacaatatcttgtatataaagtaaaaatctgaagggctgaaactcactgtcacacgtactgcagcagggatcacttcagacttggccaaacccgatgaaaatcttagctgtacgaccaagaacaaatcatgtcaaactctctggaccttggctccttacatcaaaaataagtagtgaggctaggtaaacaccaaattcccttctagctcaacatttctatggttcggttaacaagttaagcagcagtaaacactcgcatgagttgatgttcatttcaaaattattaaaaataatattttaatatgaagtcaaaagaagaaaattgttctcacttcaatgcaatgatttacaagtgtgctcattttttctgagccctttttagacatgatctcagtgtggcaaaacaagtaatagttccaaggaaggagcatgcatcaccaacataacagtcctcaaaagatagatcagaaggaaaatgaatagcgtctcctcacaggtacactttctcccccagattttcagttttaatgtctccccttactagggtctctcatagactatccacatgggcttctgtctttgtgaccactgatacccaaagaatcactgtttttaaattctaaagattacaccaacgaaagtcaggagcgtctgttcacttaaagtggctctgcccactaccaccttttcccagcatggaaatgaggtacacacgaaagctttatcgtgttggtatcaatgtattccaagtactcaactattttataagccttttcaagtaatcttcagtcagtaccataattgtcagcacgtttgttctgtgttggccacccttccttttgtttcagtctttcataaaaatccttttgtgtgacagtcaagcagctgtgctttgttctttaatgttcctagcctggatctccagccgagaccactttataacataaacggcaaagtaccattttcacagcggggacaactgtgttcatcttcaaaaagaggcattaataaaatgagactgtaatcaacatgctaattctgatcacagggtactgcacaatggcagagatagttgactgccttctccctgaaagattgtaaaagttgtatgttttttttcctaacaactgccataatggcttacattttttgaaacagacatattatgcaaacatttctatttcccattgcagtgccttctctgtctcatccaactgctcactgtgtgttttactatctcagtaacagtcaccttcagggagcaaattttttccatcttgcaagaactgacttgctgaaataggcatgtcaatgaatcacggaaagctggagaggggtgatctgagtgatttcatcgctaatccaaggccttcccaatgcatatcaggccaaaaaaaaaaaaaagaaacagaacagaacagggaagttaacgtatttgcttaagaatccagttattttgtgacagagctaaagctggaattcaatttcccaagacctagacttgggtacttcacgtattatcttttgtcctaatggtgatcattcacaaataatatatttatatgtaagagtaggtacacataagtatcacttgatgaaatatatttgctaaactaggtaactaaaatgcctcatatctggtaaactagcatgtttagacaataattgtactgtagatatgttctatgaacaaagccagttccctataaatagataagagcagcagtgttgtatatcataccctgttctgttgtgctagtggtggtggtggtttggggcagtgctatttgagaacagcccagtctaaaaataatctactaagattttttaaatgacccattacatgctgtttgagataagagcaaaataatgtattttctgattactcccctaaaaaaaattctaagttcaagaaacatgatgacatttagtaagatgcttagattcaaagttgattaaatggttccagaactttgtcttagagaagggaggttatgtaagtaagaataattattgatgtctttcctcttgcccaaaagaagcaagtacccttggactcttactagaaagaaaagtctatggatggtgatatctcattttccctgcctagtgattgataacatctatcagagagaatattttcatcctcagttatcactgcataaatttgtattacatggtttcctgctgatatctttagtcaggaagaaattgtgaccagcaaactaacgaaacagacagaaccaattccatttagatgacaatccctgttcttacaacactctctctggtcctatgcttgctcttcactgaaagcctgatagttaattcactgtccttagtagcattccacaattagttaaggcacagtccttagtagcctcagtacatcctaaggccttcacttaaagttctgcttaggatgggaaaacacaagtaaaacagatatactcagcctcctaaagtgttgtatcattagggagtcagtattttcttgtgtttccatagccaagacaactaaaaaattaaaatgacttggaagacataagccctacattcacctcccccctctcctacttctttcgtgaaccacactctatggtatagttaattgcccaaatatcttatttcggggcacattcagcctgagcttgtggttatccctccttattgaaacacagtttttgagagtaagggtaatttgaaacaagctacgaagggaaacttgttcctgaaatgctcccttcgaggcacatgggtggtcagagtattatttcaatgtcttcttcattaaccatacaggtcagatatttgaatctccaattaattagtttctctagtagcttgtgtgagataaatcaatgatcttcatccagttcacttagataaagcccatcatgagagctggcacatttttggcatttgtcagtaaagcagggagaaagtaaatgatccacgtggacgaaatgggaatctaatgaggccactggacgaaaagtgtaaaatggtctccatctactgcagaacagagtgcctgagtgtccgccaacatgatttgcaagagaaagtgaacctaaaatctcctcaactgtggtataaacctcttcacactcatttatttagctattcatgatgttcaaagtctatgaatgtcagtttacactggaatattattaaacactactattaatagaaataacaatatttagaagttttaagcaaacagtgactccaggaaacaaaaataatttccatccatatttattttatcctaaaaggatatataaaagtattctattttaagattatgtttagactacctttctgtcatctaaaatacttttgaatttttctcatgaaagttctaaaactgctcaacatagtctttaaaaaaatggaaagggttaactactcaaatcataaattttcatacaagtatacttacatatgacagatgttcacatagaaagttgagaccatattaaacatttttgatgcatttgttttatatggggactagctgtataaaagcagaggagatgatgaaactccagccaactgagagacaggaaaacattaatccatgtaaatttctaagtaaagtgatattttgctccaattttttgttaatgtcttcattggatgcataaagataagtcaagcacatgactgccattaattccttttaaggagttcaagggatttggaaagtgagaaaactcaaaaacgtttctgataagttttattttattgtacctttttaatataccttctatatgatggcactgattctaaactaggtaaataaatggagattaaaatttttaaagcagatgaacaaatgagccagatttggcttcaaatatgaacacctgaaaaatgacaattttcagacaagctgaagtgaactatgtatgtatattcagaaatatgtatactttccatagtgcatattacagcacatataaacatagtctctaagattcctgccagttctaaaatctaatttctaactcctattcttttttttccctaatgtcttattcttgcctattagaccattccttcctttcccttttcaaatattttaaatatattttgaaacccattcatacagttcagttacctgtggatcagagactatgatttccacccttgatggttgggcttactgtcgcttgctggtggtagctgacttgattgctttagaactggtgttcattagcccatctgggtatgaacaaccttctctagggttgtgtatctggattatcggaatgtctctgtggggtgagtgctattatgggtgtctgttgcacactctatgggactcactgtttctgaccagcttttatgttaaactatttggtcctgagtattgcacagtaggaatagtgctggaaatctcacttgtatgcagaaagctgatctagtctctgttactctcaacttattttatatacgtatgtatcttgctggagtgttaaaactccagcactaaagcataaggtccattttgttattatcttgggttattacaattgtcttttctctaggaaatccctcccttgtttttagcaactggaaatttcaatttcttgtttgtaagcctaattatgcttttaattttattttcagatactttgtcaacatttctatgtgttggtcagggaatggggaacttcctgcaccaacctagcttgtcataacagccagaaatgtagctcaaatctcacttgtctgttttaaagcagcatctgttacatgcatttaaaagatatacatccaattgtcaatactttccctgcaacttaataaggtgtttatactatttcaaacgtaattaaggatatatatgtaaataatctcattttctcagcctcttgaattgcttctttgtgtgtgtgtgtgtgtgtgtgtgtgtctgtgtgtgtgtgtgtttagtttcaaaaccaccaggtaaatttgacctacattactaattactgctggcctccaaataaataagttcttgacaatatcaatagggcttacctccttgaaagaaaccaagatgtttatcaaatcaaacttttttattttataaaagatataaagtaaaaccatccctccatgggggtaaaaaaaatgaaatagtagagaaatgtacttaatctacataagttcctctatgattctgattgtttcctttccaatttctttcatgttaggaaagtctattctcctaaattttggaacagaggaaaatacaacaaaacaaaacaaatgagttgtgtgagggagagaaagagataaaggcacagaatagttaatctggaaatgtcaactgtgaggtgcctaattgggaatgttcgtatctctatacagaagcctgaattagagacatacaacacagtcttcatcatagctttattctccagcactctcattgtaaaggaagtctacaaactgaacacactgtactggagatctggcaactcaccctgtgcctttgtcaaattgtgtaagcaacattgttggagacaaagaaagggatttgtcagcccagttatttagatcaatacatattggtttaagaaagataacagacaaataaaaaatgtattttttttcacataagacaggtgcatttcttatacttggttctgaccaattgcttaaggaaagttcatctttaggctaaggttctttctttaattctgcaaatatcaatgtcagctgtggtagttgtaaaaaacgtagctgctgaatacagtatgaaaaatccatgcacgagtaatgccaacatataaaagagtaccatatcctgtttcctttctagatgctctgccaaaaatcaaaatggtatctggcatttgaagtcaatgcttttttcagcttttttacctctgatattccccctgaactctagttctgtaaagacccaaaactagagaaggtatccactgtctaattaaagttcaagtcttacaaacatttaactgagtttcccatttaagcaccatcacaatgctagtcttttcaatgatgctacaaaagagatacagaattgtaacaatgacacaaacgacaaccttcacttgagcacttaccccgcaaaactgtgagtctggtggatacacttatttctcccacattatttgaggccacacattcataaatggcctcatccctcggagtccgtaagggttgtattctgagaactgatccagacccatcgtcaaactctattacctattagaggaaacaatagctgtcacaggtgttgttacaattgtctacctctcagctaaagctctcaatacagtggtggatccgccattaggctcataataaactaggcatcattctgaaactgaattttgatatagtggtgaaaaaatatttggtctaatttagtgaatcttctactgaacaaggagaaagatatgcaactacatatgcaaaacatggagatttctagtccctactaaaaactaccagggtttattcattaaaatatttcagtatgttcatctagggcaatttgactctattaattttgcaagaggcttgcagctataatggataaacttcttaaattattctttctctcacagcacatatacgaatgtggattcattcaataatgggactgtaaggtgaagaattaatgcatgccaccacagatagctctgctagtttaaactgtctcatcctgaacagtatagataggcaaaccacgaaaagaaattgcataaatctagtacttaggcagccaacgagacagctttcacaacccaaaagcctgatggtgtgcattaattttgccataaatcattccagtatttgttctagcttagcattttctgcatttttagagcattcttgctgtaaaatggaggcttgcttcaccaggcagaaaattaatgtcctaaacactaagcctgaattcaccatcattaggaactcttcttggaaacagtttagtgacactgataatcctgggtacttgttagctaattcaagtaccacttaaaaaaaaaaaagatgatgatattaacaaatatgtatacaatattatggagtcctctgtcttttctgtaactatgctgcattccttcagctgttcactgagaagttgtgccttttttctcttgtatttcactgtgaatattcccatgtgcctaaattatgaataaattgagattgcctcatatatatatttatggggtgcttaattccagattttgtgtgtgcatgtgtatattaacacagagaggaaggacattcatattttcaaaatatgtccacttcaatctttgtgcattccatttttgttcaaaattcacaaaaatattcaaaatggcccatttctcaatgcactacagtttattttcaactctataaagcatacactttaaaataaatctactatgcatcttaggaaagaaaagtttcatagtttcatattggaagctttgttaagcattccataattttaaaaaagttatttatgatcattttatgatttaggtaggaaaaggttaaagcaactataaacccaatttaaatgttgactaatttattaataaatgtcattgtatgtttacatttgtgaactatttcctagatttagatctatcctcttacaacatacaatataccacacattacacgccagtgatgtaatttccagtttgaaaatatccagtattgatttcatgcctgccatggaccagacaccatacttagcactggggatagaagagggagcaaaaacagtcaacatgtactgctctcagggaccatacagactagtaataccatatatattgtttaataatatatatttaataatatatattaaatatatattatatatatattagtgttaaatatagtaaagattttcaaccaaggacttgatacagtttgatgaagctgctttgggtaaaaataattcatttaccccaaaggtgtttatatgactctcatggggaattaggcattgagcagagatcatgctgtgaaatatttagtagtataatttcacttttgttacatgattttgtcaggagccattgtcattagaaagcgtgatgtcaaacttctctttgacaaaaaattaacttcatttaaatttttttaatgtgcagcaaagatgcatacatacatcattttctacatgacacaggaaacattttccaaatattaaagatatttttgtatttaaataaattatatttcaataataatcaagtatttgattttcagacataattttaaacttctcacttgtaaactacaacccaatttccaatggcaaatttctaatttcaccattgtaattaattaggttctctatacatttgaacccctgatcaccctgtgagttcctatgaaaataagtaaaataaaattgttctgaatttgtagttgctatatttcttttaactagaaattgcctttaatctgccaaactgtaaattaggtcatgaaggagattagaaactcaggtaaaagggaggtgagtttcacaatttcaggcagtttgggggtattggtagcccctaaaattaaagctatccttctcatgtcttaaattatgggcatgctattgtgtgcccataatctgtgtagctttctatatatcttattgcctatatttctcctccagaatgagcaaatttctaaaccatcagccttctcacaaacactcaaaaaaagaatctttgatttatgtttcaccatcttcgctgcactgagctctcctgaataaagaaaaccaacttcttcgataggtttctctgcaatatcaacctgtttgcatgtgtttctttcagaatagtactttaaaacactggaacaaatttctcattctagttcacactacttgtaaaacacaggtgcgaggggcagtggaccacttcatttgctgcttagcatccattcccattcttcttgataacgaggatttaaatttcctttgggaaaattctgctctttcattctaagccatgcaattggatgggactgtcctcattcccagaacagaggtagattctgattggcttaaattaagtaggctacactgtccacctatccacacaaattgtctcagggatgcacaagtaacgtaataggagccaatgggatgagaggcttctggaagagacaagctttcatacatcctacagacgtggtcctgtgaggttgcagagctccatcttgcaacctggggatgaaactgacagactaatcctaggaatactattgagccctggcacaagtagaaacaaaaatcagcccttgaacccccaaatttccttttttaaaaagccatttagagttacattttccatcacttgcaatgtaaggaataccatatatcagtgacaccttttatcagagtaaagcaagcaagtaacgtagaaaccaaagacagagcagatacattcttcccccagagaaacagaacaatggacctaatacctcaaatctctgattgctgactttctttccttttttgttccagacaattttaggtcttgggtctcccgtagcttggcagatgaaagaggcaactccgccagagacccctgtctgatcaacgggtgttcgtgtaaaccttggaggtgctgaaataaaaaataaacatcacagttaaattgaaaactgaaatacagactattatcctactaccgctgctctccccaccatcctcaaccacaccgccatcaagacatacatttttacaatgcactatgggattacaaaattagaaaagcatcttttacttttgagggtagtttaaaggggaaggacataactttctggttaagttatctattagtgcttttattgctgaaatctgtattaaggtagagatccaataacatccgaaaagcaacatcacacattaatttttattaccagtatataaaaaaatccaatttgtcctctaacaaaatgagctcatcaatcaaagtgggtaaaattttagcgcttgctttgatgccactatcaggacactgccagaaagcagcattgccactgctgagctattaaaattagtgacatttaagagaaatgctaggaaattttaaagagacaagaaatatcgccctgaattagaaggtttcgcaagaaatagaaataggggaaaatggtaaagtgactctctaacccagatattgtaagctgtcttacttgaaacttagctccacaatttgcataaaagaagatgagtcaagaagcctccaaagtcatagtaaagcaaagaatattttttatacaaagatgtagacttaaagattactaaggctagcaagatagacattggaagcttgttcaacatcctccatctcctttaaatgttcctaacattcttcctccttctttaaaaaacttacttatttttcatcttgtatttcaagatctagatagctatcatacaagaatgatataaaatgtaaatgaatacttatgcacaaagatattcatcatatcatttgtttggcaaaagagtataagtagttgaaacattaaacagtatgggatttctgtcacagtgaaataaaatatggcatgaagatggaacatcatacaagtagttaagtgttataaaatctgtatcataccacatgagaaatgcttatgatgcaataataagccacaaaagcatactacagagttatatgtggggatagcagataatgaaaaatgcacacacacacaaagattgaacaaagtaaataaaacactaataatggtgttcaggaggaggcattttaattatttctccgactgctttccatcttttacacttccttgagtttttacaattatgttctggctgaaaatgttttaaagccccaaaacattttgctgttccttcttttttttttttttttttaatttctaatccctgttacagattttctcttctctcctactgtgttctacttacatgtcattgaaaagtggttttaaataaccatagctaaaattgattttgaaaacaatccttggattataaaaaagaaaaaagtcataacaaagtttgttcttcttggttcatcaccagtatcttctctgtattgatttcatgtttcccacatggtgttcccattaacttgatggtgtgttctgactctgtttggttttcttggagtcaaggaagccggattcctatctaagctccaccaatacatatatggataatcttggaggaaaaaaaatcatgtaactttaccatttcttggtatgacatatgaaatacattaatttacaaaaattgcaaaactatgacatatgaaataaattaatttgcagaaattgcttccagtttcaaggtttcctagctttatatattatttccaaaggagggaagttcagaagaggcatatttgcaatgctggtcctggagaatgaattaccacctcatcagcaaattcaacttgttggtgatcctggaactgcgggcctgcttatgttcaaaaatattaagaaagcaaaacagcctctaacaaccctgctagagatcataacctgtagcatctcagtgtagcaatacagactagatgattactaggagctgtgggaagtacttaaaataattttattttttatttatttttatttatttatttattttagatggagtctcactctgtcgccagggtggagtgcagtggcacaatctcgactcactgcaacctccactacccaggttcaagcgattctcctgcctcagcctcccaaatagctaggactacaggtgcgtaccaccacgctcagctaatttttgtatttttagtagagacagagtttgaccatgtgggccagaatggtctcgatctcgtcacctcgtgatccacctgccttggcctcccaaagtgctgggattacaggcgtgagccaccacgcccggcctcaaaataatttaaaattgactaacagtgagaggattacaaaacactgtacattgatgtcacttttctggaaacaaatgaaaaatatattacaagtttttatatttatctttctgctgtttcaaacaatgcaaattgataataactacttgcttgtcagtaaccaatggaaaaattataattatgcaattaaaatttctagggaatttccctagaaacacaaaatagattgctgtattaaatggtacaatactgtcatttttagctaccttccttttcttgtccatagcctaaaaactgtcaaccgggaaggaaaatacattgtaagagcccagcttcccatttaagttctgttctgaaatttcttgcaagaacatgtgaatacattgaagggctgttgcataaaatgagtgtgcactatattagaaattaaagaaaactagaagtaggatacccttttccctgcatctggatattttttaagggataccgttgcatttcttaacccaaagaatgaagaagagttggcaattctgacaatctgcaactaggcaatggatgcttgggtaagtgcttcatctgtcctgttgccatgtaaggacctaaattagaaagctcatctggaaataactggtgggtgaggacaagtcaaattaaacatagaaatcttatttctaaatggagtgcagagagacaaaattcccatacacttggagaataggtatgagtgccatttcgatgttttccaggtatgtgtctcatttatctttattttctggtcaggcattgaagttttttgtttgttttttgagacagggtcttggtctgtcattcaggcttcagtgcagtggcacgatcaaagctaactgcagcctcaacctcccaggctcagtcagtcctcccaccttagcatccagagtggctgggagcacaaccacacaccaccatgcctgggtaatgtttttattatttgtagacatggggtctccctatgttgttcagcatgtcttgaactccagggctcaaggatcctcccgcctcagccttacaaagtgctggaattacaagtgtgagccatcacgacacgcagagaagtttttgtgtaatattgacaagtataaaaatatgccacccaggaggcagaggttgcagtgagccgagatcacgccactgcactacaacctgggtgacaagagtgaaactccatctcaaaaataaaaaatttaaagaaaagaaaaagaaatgaccattggatgctactgtaggattttatttctggagaccaagtcatggaatgaaattaacctattgaactgtggtaaacttattaaaataaccagttagaatctattttaggacctggaactatttttctaaatcctaccactgtattgatgtgatattcttaaaaaacaaaaaaacaaaaaaaaaaaaaacaaaaaaacctaaaagggctcttaaatttattctttgaaaacaagaaaataaaattgatcacactacagttaaataatttcaggggcttttacagagaaattctgtaaaaaaaaaaaaaaaatacatatatatatatgaaagacatcggcctcactgacaagaaaatcatgactttcctatgggacccaatgtcaatttttctagattcgcccacaagatccgaactacaaaaaggatatatgtcatcatcctatgatacaaagtaagactcaagataatatagtaaaatcctttcactaagcatgggtggtgcatatataatcatttttgctggtcaaactctcagatggtgtctgtcaatgctaggcagccagccaaaggaaagatatgaggtagagagaagactaaacttaataaccccaacaaatgcttgaggcaagtaaaaatctttattctcagagggatataacaacacacatcacccacttcccttctccatatctcagtttaataaaaggaacatgatgaatcgtctgccttattttgtcatagatattgtccaaatttaagccatgctctgaagatgggaagaaagggaagagaattcaagtaaagcataaaacaagggtatctactaaaaagtcacaacataggacagactaagatttgaatcgtgaaaatctccgtttttatcccatgagatacaaccatcagtattatagttagtgtacaaaaaaaagaaatatcaaggtataaagatggggagaaaggcattagaactttccagtcaccattatttagagaggcatccttccattactgctgtagctaatcaccattgccatctacctgaagctgccaatgctgtactttgcaaaatgcatttgtgctcaagttggttttgacaagtgaggagtatgatcttttattaaactaatgccaggtactgcacaggtcaaattactggtcaacccagaaagtctattttctaaatggaaagtagagaagctacgcatgcatatgcgtcacaacagagacatggccgatattctagaatgtgtctgccaggctcgcttgccattttcaaagactgtacattctcaggatgcattcacaacacaggccatagctcctggaatttagtagattattatttgctacacagctcaagagaagccacaaactgcgcactgatttttgcttttaagaagttagattgtttcttaaagtctaaccaatgcacagtatctttgaacctaatgggtctaatatttggatgccatatcatgtttcaagttgctaggcactctgaagacaaggtgatgagctcaatgtgcacttatagctattaaatgtaggtgagagaaccaaccaagaccagcaaactgcttttgtctgtccttaacaaactgccgtactgaggacaaaatcctccctttcgtacactatactaagtagtgctagacataaatcggggagagccattgaagtccaccagtaacatccacagatgaatgcaatttatgagaaattcctaaaggttaagtagataacttagagttgaggtatatgattggccaactgacttaaaacagattcatagaaaggatcacatgctacaaaagtgaagagacaaaatgagggtgccatttatctaatttaattctaattaataagctgtttcttgtggacatcaagaaaatatgtggcatggggaacaaaactaacagcatgtaacgaattggctttgtttcttttaactgattaacatttccttaaatacagagttttgtttttaaagggctgtttgtcataacaatgtacttaaaatttttaaaggggaaggtgaatattgctgttaaatgagacagggagagaatgttcagtgggaacatgcaggtacccctgtctttagcaatctgcttcctccttaaaaagtgcctgtagaatttatgagaagatcagctgaagtcatctctgatctttctttctctgtaagcgtcaggatgagagctctgaaggagagctcaggaacagggcctttggggtctggtgggaaatgcagtgcatagcagaagagtgaggggtggttccaagggtagtagcctggtctgaaggtttgaggggaatgagttaccatgggactttacattcccttccagccacagcacatcctattgacactttcgcaaacatggggcatccagagtttgtgtggatgataggtttttgttataattagcttcattttcactgggacaagggtagtgacagacaacctgcccaagtcaacagcacaactataccaacacatgacgaaagggagggaggtcccaaagttgatgtatcattgcttaggagggcaaaagcatggcacagataccacctggggtagcttccatagcagaggttctacatgaaccagggcctgtggggacagtgaatctgtcacatgaaatttgaacagggtcacctgttgacatctgtggtcaggatagatcttcaaaatcaaacagactttcaaaaaaattgtttatggtatttctttttaaatacagctcccaaaaccacctgttagttttaaaatttgatttaagaagcattatactttagaatggaataaagaaataactgctccttgagttccatgcactagactaaatgtttaatatatcttatatacggtgttttcaaagagtcttgcaagatgttatcattactcctattttatagatttatagaaagctttttagtaatataggtattaggaagggagggagggaaggaaggaaggaaggcaggaagaaagaaaggaaggaaggaaaatatatgaaaagacagtaaggaggagtcactgaggttatgagtgagagaacttctgatctaattgtgaacccctcatgatggcagcagcagcaggccatgtggagcggccactgccctcacactggctgcagatgggctgcctcagggacgcagggcataggggaagcggggaataggggacccaccaccaccactgctgcctctgcagccactcctgccaccactgctcgcagctctgatctcagagcagagttgaggccgagcctaggtgctgtcagcctgactgagtgtgcacatgttggggcagcactgagacaccagccccttgctgcctcagcacccccagactttaggtactgaccagggtggaagggaagccaagtggggagctgagggcaactcagggcctgcagatgccccttggcgtgagcagcctgggtgccacagttggtggcaggaggcagacaggctcctgggcagaaggggatggatccggtgaggtcccaccttcaggccagggagggcctgaagtctgagtgctgggctgtcagccccacagaccatagtgggaactggtggtgccttttctgggaccgcccatggctgtccatggaccagctggcatgcacttcatcccctctgaggcccataaaagttccaggctcagccaaagcaaagcagatgggacaaccagctgcaaaaaggcacgactctctctgttgttagctgaacacctgctgggatgaccagctgcagagaggagctaccctctctgatgagaactgaggacttgcttaacagagaggagctaccctctctgctgggaggtgaacactccggacgacctgcctaacagagaggagctaccctctctgacaggagctgaacattcatcaggacaccctgagacggagagaagatgcccactatgggtctcctctgagctttcctattgctcaataaagctcttcttcgtcttgctcatcctccacttgtctgcatacctcattcttcctggtcacaggacaagaactcaggaccagccaactggcaaggctaaaagagctgtaacacaaacagggctgaaacatgccccttgctcaccacgttgcagatgaagagaaggagagaagggctgtggccctttgaggaccccagacctgggagctccccaagccagggctgtgactcactctttggggcctagtggttcctgttgtttccaagtttccaggtgccactgcattcaccagtgccagccagggaagctgctgtggtgctcctggtccaaccgctgcctcacggagaactggcagccatactagcacccggaaccgcccaccccgtggcagcggccaacatgtctgactgtgcagtgaccaaaccccacgttcactcacacaccccttgccattccatgcctgactcgcagtctcccttgaagacatgggatccaggccggtagtgtgagctgagtgcagcctgccaggccaggtgggcagaacaagaccaacgggcctgagcaaaacttggataaaggtgccactggccacagaggtttctggccaggaaaataacaccccaaagatcttgtaacactaatattttcactgtgccaaattacaagctagaaaattataaagattgcacagataatatatcgcaatttattaaatattttgaaatatcttttatgtaactataaaatgtatactgattgtcttctcaagggattggcacgtactttgtgccatactacagcaattatttttcactagctaagtgagaaacttcacccagaatatgctgtatttaaaagttctcttaaagtgtaacatcatcccaggatccaattgaaatcagagattacgatgtctgaccaagagacaaaaatcaatgtcagaaaattcataaacaaatcacccaaattccaagtttagcatggtaggctactttggtattattttacttatacattccatttgctcatgatttaaaaagacaaatacctcaatacagttcttgacactgattaactctcttccatttcaagacacttcaatgacatatttctatgcatgtctataccattaattttatttaggcctcaactctcaattcctttagaatgagtattaaagcatttcccatttggtagatagatatctatgcctctgtatgactaccaatatctaatttttcaaagggctgataggcacactgacagacaggaacagaaaaggagagagaagaagaaagggaaggaagaaatgaagagaggaagaaaagatttaatttagtgaaaagattatctcccacttgcactttctatcaatgttaggttattatttctaactgcttgaaagattaccttccagcatctcaaaattgttgtgttgaaaacataccatgtcatttgccttcccagtccttctcctcttactgagtgttcatttctgtttttggcatattcactctcccatataccccacctaacagcctcagcctcctcttctgccttctcctttgcccacaataccaattattaagttctactgatttatcactaatatgtcttatccctcttttttgtacccaaaaacaatggccatggttcactcctaaactggacattagaatcacctgggagtcctaaaagaaaaaaaaaaaaaatgaaagctacaggtgcctgaaccccaccctaaatcaattaaaacagaaaacagtgcatgggactgggtaattaatttacagaaaattccaacatgcaaccaggattgagaattactgaatgatgccatgatatccatagcttcccatctggtcactctcacttcaggtgcttcatctcgacaatcaatattacactttactatggatccttcttttgttttcccttttcgttctttgagttttgttttctaacgcatctgtgactacagctcttttccgctcaaaaaataataaaccaactttaatagcttactcctgcaaactaacaccagaaatactgtttggcctttaagatatttcagagctgctgtcaatctattttcccaaatacatttccaccattgcccacggagaacctaaaattctctcatctcgatgcctcagtacaggctgttccctcatgtaaaatgccttctttcccacttttgaatttacagaatttacccacatttttcaattctaaattaagtccttggaagccttctttgatcttccccatctagatgaaatgtaccatcctttcgactcccctatcacgctttctgtatcttttatgaatcacaatagtctatatttcattatagttattttaagcacatgtgttttctcccctttcacattcatagaaccttgagaaaattatacatgcccctggtcatctatgaagtcttataactcccaaccatacccagcacatagtttcaatgcatacatgagcttggtaaaggctgtcccagatactatcccctaatcctggactatacacttttgagtatttaggacggataataatatcgtaaatgtgatctttgcacctctattacacgtatatttgtttatagtttggcgaattagctatggaatacaaagtctatgtgacataccttgccactgcaatacattgatatgacatagtgagagacgaatagatccatgcgaagccctaagctggcaaatgtagcacagccagattacagattcatgtgtatcatcataggactgaagtttagatgaagcataatataacgtgatgagtcttttctcttttatgaatatcattccacctcattgtcatcacagagctctcttcccctctaccaccttttgtgtttttaatttttaagtaaaatgactttactcttctaattgtacgtatttattataaattagaaaatgtacatgagttgaaaggagatattctaatggtgatcaccttgatgaataacttttaagaattttccatgcttattttacatattttttaacaagaaagaggttatatcgtaccattattttgtaaccaacgtttcatttagaatatactgtgaatatcttttatgaccacaaataaattcatcatgtttatattataaagagtaaagattacatttaaatttattgttaaacatttaggttgtttctgctatttcaatcagaaaaagacttcaaaacttttttgtaatcatatctttgcacatatatgtaattcctatatgtgaattactcctacatgtaaaattactgaattcaaaaaagtatatttttaaggcttttgatatatttaacaaattatacttttaaaataattcatatattcatagcagcaatgtgtcagaatgtccaattacctagaccactgctaaagctataacttaatactttatcattggccatatttttatccactgtccaaaataatgaattgcaaacatttggcacaatgtctacatacaaactaagcaaccagtaaatgttcgtagaccattagcacagctgaccaaccttctagctctcgcatcatacccattcctccattccagttgccaccatgggacttccctgccagttgccttcaacatctctgatctcacctgggattatttcacattccagaacagcatgcaatcccagcttctgctattcacaacacaagcacacgcattacaacaggacaatacacatgcatgaagaccataacgtgggtcagagcagaaaagtggaaatggtatgttccaatgtttgagggaaatttgtcataattcaaggtataataatacctggatcataaacacgtgttttacagcaacgaaaactgtatgatctcaccatcataactttttatttaataaacagtcatgggatattatgacaaaaacaatcacctacattctgtgtgcccgggcaataaaacttcctgaactattgatgtgcttagtaaggctggccattctgttttggtgtaagacactcaaaataaccactggtttagtgacataaatttcaagaagatggcctaagtggttttgaatcactcatagacaaaatctgtgaagtcattcttaccattccttatgccatagtcatgcattcttaatgaaaacatgttatcagcaacaccatttagacattcacttaacatcttccacattaagcctctagatttgcttactacctatttatgcattcaaaatactcagactgtgcatccgttttgttcaatagagtgataaaaggcccttatactgaaacagatgagaaagttatgcattacatacaatctcccaggctcattcagcagagatgtaggcaaatgacacaatgcttatcagcttttttcatatttcctttaagtggtaacatactcaggaagccatttaatatagacacactatttgaccaaaaagaacctctaccaatgctttagcatctttttgtagagttagttttcaaagcagattcatttacatcatccactgctaatttactcattaatcataatttatcacattagatgtgctgatcatcattaaaaataatcatttattctctattctaacctgctgcttatcatgtacctgcaaattgggtcacacaggaaaggtaactggcttatttgaaaaggaacatgagagcggataaaactgaagtgggaaagaaagagaaaaataaagaacaatgccatctttcccaattttatgttgccaaactccagaatatcctgccacttcttctatacaatatttccagtgtatcaactacatgaatttttaagaggaactagtgtgatgaactgtactagcttcactttagaaacagtagtaaaccagttccacaaagagaagatctgctggtgtcactgtatgagctgaaaggctttgagccaatatgaatttttgtaacgcttgccttccaaccaaagtgagttattaccacaacttacaaaaacatagaccatttcttttaagatagatccatcttacaggataagctgaccacaacttctcatctatcaactgcacactggttaagttggcaagatactttgggaagtgaaagtagctactatatccccaaagtagctataacacagaagggagacgtgtgtgtacacatgcagacactttcaatgagtaataaaacagatttaaaatgatgtttgattgtatttactggagaaatgtagaagtgtattataagaaatctttgtaaacaaaaaaacatttttatagatacacaattttgatacataacaaaaatgtttcatgtagcacaaaatacaatggaaagtgatttgcctgagtttttattacaaagattaattatagaatagagttttacaatacatatttcctaaggaaagtctataattaatattaacttctaaatattatgacttttaaaatattagatgattccaatgataagatgcttaaatatttggctatttaaaaatattttcttggtacgcaacattttactttaagggctatttttttaatgttttaatttgtttttttgttgagacagggttttactctgttgcctaggctggactgcagttgcataatcatggttcactgcagcctccacctcctgggctcaagccatcctcccagctcaaactcccgagcagcgaggactatgggcacatgccacaacaccatgctatttttaaaatgttttgtagagatggggtctagctatgttgctcagactggtctcaaattcctgggctcaagtgatcctccggcctcagtctcccaaagtgctgggattacaggcatgagcccacactcagcaagggcaacttattaataagaatgtggatatgtggacgggcacggtggctcacgcctgtaatcccagcactttgggaggctgaggtgggtggatcacctgaggttaggagtttgagaccagcctgaccaacatggagaaactctgtctctactaaaaatacaaaattaggcacagtggcacatgcctgtaatcccagctgctcgggaggctgaggcaggagaatcgcttgaacctgggaggcagaggttgcggtgagccgagatcgtgtcattgcactccagcctgggcaaaaagagcaaaaaactccgcctccaaaaaaaaaaaaaaaaaaagtggatacgtgatggataaacaacgggaaacataaaaggcaaagtaaaaaataaagttgacttgcctatacaccagtgtttttgcaaatgaaacagtgacttaaaaaatatactgaaaaatgcccagcattattcacatttagaccaataccctgacagagatcatattctaagtttataaggttcatgtcagttttattttgtgcaatacctaacatgttgtaggcattcaataccttttaaagtaagtataattatttttggtcctatggaaattttaggtatgtgtctatgtcccttccagatatttttcactaaatttagcattctttttttttttttaattcatttctctgcagacccaaagctctaagctgaaaagtatttggcaatgatttgcaggcttccaaatattctcattcagtatcaggtaaccattagaaccaataacattttgtaggatattaaaattcttattttctggtatacttccaattgagcacatgtagcaagaaaccaaacggtatttattttacatattaagtccatcttttctacacaaatatccaaattcttttttagagtgaagagaaagaatctatattcatatatgcaagatgattatgagaaaagcgttctgcagatgtctccccacgtttaatcttgctaaccacgatggatctctgcattttcacacagtggccccgcccattcacaaattctcctgagtgagctatttgggggtacaaaagatggaaagcatgacaactggttctatgctcgggctctgaaggcatgtacaagcaagcagtgataataatagatgataacccaaggccatgaactaactctgtccacacagagaactcaaattgatgttaatcggaacctggcacacggatagaggctagggtacgattccttggtttgtagatggaaataaacccatgaagaactttaataaaatgagttctagatggaacacagtgtaatgcagtaatgtagttcttttgctttttttccttcccagctacatctctgtaaaataactctatcaacatttccatgacagcattttaaatctgaggagaaaatgtttcattcttgccttctgtgaactgaaacacatacacactacaaatttaaaaaatcaactcaaagagggggaagggccgttttttctccctcaccgaaatctgttatgttttggccaatctttttgttacctttttccaaatggcattaaatttgtgaacatgaatatgcatttcacctctcctggtaagagaacttggataacacttggcactatagacacaaggtaacactacacgaatattcttgaaacaattttcagttggattacttttcaaatatcaagtccctaatttgtatccccaggcagtgcagaccctggtagcagctcatttcagtgccgattatgcacgcttttctagagaaacacattatctgagccccaggaatatgggaggctttccaaagaagcacagacagtaaggacctttatttgccagctaactttttcccctgtcctctaatttacagctcagggtattaggtaagaaaacaaaggattttcccacacagaaataaactttttgaaaaaccttcaaatgagattttaatgacactatttaccaatatagaatgcatgccgaaataaactgaaacacttctggtggtggatttttctttttccttttttctctttttcccctaatttaactattgcaggcaacatcatagcaatttaagttggttttgtgacaaattattaggacacttattttagaaggaaaatcaaccaataattactgccctggcacacggctattgttcacagcataaacagaagctgtggctgacagctgatgggcccagccccctgctatccttagaacacatttgcagatacccaagcctcttgccagactaagacatgctgtagcaatgcttttcatccaacagagctgcactgaccaggttatgctggctacaacagaatgacaccattttaggacctcctcccaggttggacttagctttagaagctaaaaatactgttataaatactagggattccacttgtataataacattggcctttttgcaccactctaaaatatgaatgtgtaatcccaagtacttgagtgttagatacaagatcccaagtgtttttttagtgtccacagatcatgatgataagaagaaaatgctttcttgtatttgagtaacagaagcatttgggaatgtatgccaggtcacacacatgagattctagatgaatttaatcttagagaattagaaaaggggtctgcaggttattgtgagataagcctttattccataccaaatgtaaagataaagcctctgggatctcaaaagttgagtgatacatgctgcttctttccctccatctttatataacccagtcatagtcactaatttaatgaaaggaaaggtgctttaaagctctctgtagcacctttgttcaattttactgtctgaagttttttggtaacctagacagagtaaaagctgccttttgagatggatctaaaaatgccatgaaagtagatctcctttcagggctgttgtttcagagggaaaaagacaaaagagaaatctaaagggatgggctgcagttaataattaaatatctattagttactccaattcgctacataaatggcctctgggggctgccagagcatctttccaagtcaaagtaaactacagggaaagacaaaaacagtgtttagaaattgcaaaacaacacagttatacttttacttagactggattacatacaaagcattcggtaatatagtcattatttttttaaagggtcaatataaaggttctgccatccttcactacccatcccatgttccaaacagtcaaacagctcccaccagtggtcctgaaccctttagtatatttccacacagttcctttcccttaagaatccccagtctgttctgaatggctaagctttgcctgagaaatcacaacactgtaagggctagtaccgttgcaaattcatgatctacagcctcaactatacccctctgtcatctatcaatcaacctcccacccttcactactctccagcaatcagcactgcactgacctctcacctccaagagatcgatgcttttgcctcctacatcaacagataaaataatgccatcaaacatgaacttgatggcaagtcacatcctattcactgtatacgaatttctaacttagaaaccatttttccctttatcttattcaagaccaattgcttcacttgtgctcttgatccacctcttcgccatgccctaggaaccttggtgcatcaattgtcccatctccctacataatcagcaccttcactctcttcctctttaacagctacttccccttaaaacagggcctttcactactgacattttgggtcagactattctttgttgtagagcctgtcctgtgcattgcaagagattgagcaacatccctggcttctacccaatagataacactaacatcctagctaccagttgtgacaatctaacattatcaaatgtctcctgggaaaacatcctaagttttagcaccaaaactactgactgtatctcaagaaaccacaggatggttggtcaccctagctcagatgcctccaaacatagtcaactaccccctacttggtactgctctattccatttaaatattttaatttctgcacatttcacctagcttataagtgttcatcttctctctcttctgctagactgtgagccaacaaaaggcatgatatgtagtgggtactcctccgatattacaacgctcaccaaggatcatgcttccactaaagtttatggagtaaacgacgagttcataagatttaagcatataccctgtacatatgagcatatttggttaaagccaaaatacaagaaaaagaaatacttatgaattaggcacctacttatgcttttattgacaaagctatataatcattatatatacatgtaagccagtgtaaaaaagatacatacaaagattatattccctctgtcaaattcaaactgccagaaacttaaatgtattttcaatttttcataagcattaagggttataataaagaaaaattacctaagtgaaacaaccaataattatttttggtaaaaaataaacttaatacatgactacagtaattggtttcccttcctatgtatttatttatccttggattttagtcattaggaaggcaatattgttcaagaccattaacttgccagaactgtactagcttctcaagttgaccctaatatgtgatattattagctctttttttctgttagactttccctgtagcatcttcatcaatctttctagcaagattgtttttttcataagaaaaacaatttcacatactaaaacgtaggataataggaattcattcaagattcctaaacataacttgtaaatgtaattggaattagattaacaacaagcaatcaacgattcaaaaaaattaaatagttaaaaaaataggaaagatgagaggatagtcttcacaaagtggcaatccagcctagttgataaagtactcaactctctggttatccaaaaagacatggaaggtttcctatgtaagcaggtttcacatgtgatacttctctaaggcacctaaataatcaacaaatacaacttctgctttcctcccctgcctctttggggaaatgtgttttataattgtaagtagaattcatagtttgatcgcagaaaggctgatgtgtcttgttttgtggccagaatttattgtaacttaggggttaaaaagagcaaagctgcaacaacataatttgtttttaaattcacagtggtccttcacccctgaataataaaaagcattttctggaaatagtgtgcctcattttaccaactttagatctttaacatctgaacttcaaattttaaacaacaatatgaatatgaaggtgtgtatagaaaaacataaaggagatttaaacataaagctttgaaaaagtcagtaattaatgaacaaatatatttcaatcaccagcagagcccctggaaatgccacatatatgaactttttcacaatctttctattttttatattccctagagcatgactctctcaaccattcccacttgctttttttttttttctttttttaatatctccttcacccttttcttttatattactgtatctttggcagcacttgcttattcttacttctggtctttccaaactcacccaaaccattaaatagacagtgctatccaagaaacgtgcagttgcaatcaggccatgaccttgttcgagaatcttccatggttcgctactattgcctacttagtgcagaagagaaagtcctgttcaaagaatttgctaaacctatcagacaagactttttacatctctaatttacccgagatagcatcaactctcactattcataaacaaatcagactcctagccttttatgaaaaaaacattttttaacatttttatttcaaaatactgcccaacagccccccacaactgaatcacctgttgttacttgttaaagatgcatattctctgagaccagatcctgaatcagaatggcacagtaaggcctgggaatttgtgtcacaaatgtctcctccagatgatcttttagcatactaaaattttacaacctttttgtgtatttgttaagactattccattattcaaaaatattttcactaaaacacctgcttcttgaaagctgattccactttcagagccatctcaaatgccttctcctgggtgaaatcttttctaatccccaatcgaatatcatttctaagggctctgaactcatgtatcactgtttggcctctctcatggccagaagtagatttaccttgaccttaggaagcttcagcttcaggaccctttccttgcataggtaccacacgtcacactggcatggtcaaatacattatacaatttgtaatagtgaggtatttccctcccaagcatttgaaggccactcttatttaccttcacacacagtggtgttagaaagctacaggaaattttgcagggtccagctagggaagctgaattgaaatatatttgttttggatttagcagaatatctttatatggttcacagttaaattattactggccttccggtataggaaaggtttctgggaatactccctactgctcactttattaactcatccagttccttagatgaggatgtcagtgacaaactagctgatatgtcataaattcaaagagtgttacaacctgtcactgtacaagaaaactggaacaccctgaaatcacatagctttacatcacagaaattatcacattaccaatagtaagttgtaaagatgaaagtttatgaattattaattttaagaaatataaacttaataattaccaatctgactggcgagggatggtagctcattatggttttgatttgcatttctctaatgatcagtgatgcagagcttttctttcatatgtttgttggtcacatgtatgtcttcttttgagaagtgtctgttcatgtcttttgcccacttttttttttttttttttttgagacagagtttcactcttgctgcccaggctggagtgcaatggtgcaatcttggctcactgcaacctctgcctcccgggttcaagtgattctcttgcctcagcctcctgagtagctggaattacaggcacccaccaccatacccacctaattttttgtacttttagtagagacagggtttcactatgttggccaggctggtctcgaactcctgacctcaggctattcacccaccttggccccccaaagtgctgggattacaggcgtgagccaccgtgcccggcctgcccactttttaatagtggttttttcttcttgtaaatttgtttaatttccttgtagagtctggatattagatatctgtcagatgaatacgttgaaaaaattttctcccgttctgtaggttatccgttcagtctggataatagtttcttttgctgtgctctttagtttaattagatcccattcatcaatttttgcttttgttgcaattgtttttggggtattcatcatgaaatctttgcccgtgcctatgtcctgaatggtactaaggaaagcatacattttactaagtctaagttttatatcctctgcagaaattggcacatgggttttttttaaaggcacacagtagtctctcactaaaagtctatctaactaaactgacttatttccatgatcataacaatttagatttcatttcaaattatttcttataataatgttttacatccttttgtaatactttataataaattatcaaattattttttctggatttcacaaatttatttgggcttggccaaaaatcttagcagcaaaatattgcttgtctttttaattaatgatgtacagagaatatgctttgttcttttatctctccccgaaataactgaattgagagaataatgcagaaaatgtagaagttaaactgattcttttcagcttatttggaccctaacatgttgcctaattacaatagcagtgaacacccacagataacatgtataacagattttatgggaattaaaggagctctataaaggactgatgttttcttaagcctattattatggaagtttatatgtaaatagcaatttaatttttaaaatccttactactagttgcaataaatgttcaatatttggtaaattaacaagtgctatatgagaaccactgtgagtccctctcagaactcacattgtgtcctattaaattgttctgacctttcccattaaggcaatttttcccacaaaggacatattgagagcttcaatgagcagtttttaataagttaactatcaagaaagatatttttctattagtaccagtagccaatatgtctatttttaaaaaatgatttcagtatttcctccaagaggactagattctctcatacgtatcctcagagatccacaaaataatatgaatttggccccataattagttttgcaattttgtgcagcatctagataaaagcacatttggaaaaaaaaaaaaaaaaaggtgaagacaagtcagaaattctcctttttttgtcctttttttgtatctagatggaaacactaccctagctacaaaggatgaggcggtatctatttctaccattgtagagtatttccttcaagaaggctggaatactacatttccttgatacggaatccctgatatataaaatgaccaacataaataaatacaattgcaatggatatctagacaattaactaaaatgctaatgaggctccaaaatccagctttagtgccaatttttacatagcatctcctctaatcgttcatgattatatttttgccgcaggccctttgcttccttcatccttaggaagccttgaacttattctcatccttcaacaatgtcaaaagaagtaactggaaaaaaaaaaagtgacaaaatcaagaaggacactgtgccattcctttgaagcagaacatttctgaatgagaggggcatgataattatgcctctcagatgcatatccacatttttgctagccatggtccttgaggatttggagacatttttaaaatgaatttcttcaagtgaatgctgagacactttggctgcaagaatctcaggagactgtgttggccagatggtggctaccatgccagagaagtcacaaaatgttccagctgaaaactgatttaagacaaggcaacaattccatattttatgagccaaaatattacactatcccatcaagagtcctccagattccaacctgttgttatcaccatgaccatcagtattttcaaatactactactaaataaaaaccagtcaagaggaaaggtttctaaccctctccatccaggaatatatctttgaaggtttctatcacttctaacttattttacaccatgttctgaagtaacaagctatctaaagtttaaataccagtagagtggattcccatctgtggggtcttggaccaagaagagggtacagaagtaattgattggggcaaatagaaaaggaaggaaatccttaaagcaaatatggggctgttcacagccatttcatcattttacagggatctgtttgagaataaagaaggattccaaatttaaaaattttctacctatggttttagatgtcactacaattaatatcaacgttctctaaattattagaatcattcctcttcaatgatgatatttgatctagagaaagaatattatcatggcagtgtaaaggaattattcaccaatgaagaataaatgtagagagagagagagagactggttcaaaagataatgcaatatcatacctattataagaaaaagaattgttcaaaacaacttcatccaaattggtggagacaccctctgttcctcaggtacaaaaatgtgtaacatagtcattaccacttcctaatgaattgcaaatgtgtttttcagaaattattttcccaaaaagcaaacatacccacctcagtttccccaaatattaaccacatttggttgaaatctttctgaaatatagcatgtacatgctcttgtcttacacaggcacatatcctatagaagaatcaataatctaagctaagcaataatagccatacacgtaacagggatttattttttaccatcacaaatatttaaaggttataggacttgcatgtattatttgttttccttttccgcttttgattctgtgtggctccgttcgtaacagtgctttgagggttaagcccactggtggcagatgactgggtcagatgcattcaaaaagataacacttatccaaattagttggagtcataaaaaacactgtttctcacattcctgtctcctattactgagtctgctttattggttactgatctttggctcccattttcagttatgcctccaggatcctccccagctggctcccagcccctcagtgaacttctccttttgaccctggcagactgccatgattccacctctgaaaccacaaactaaactggacttgttctttcttctgcaatgacttcacatactctgcatttggtcctgctaagccctatattgtatcaggcagagcaatcaaaaagcaaacctcaaagaagtaaggttttatatacaaggactcttgactttccacttactctttacctttttaaatttcattccttccatcaacttacaggaccttccacaacctgacagttgtcctggatagcagtaacagtgagcaatatgactccctaaaaactaaccttcatatggcatctcagacctcagaaaatcacatgagatttatcatttaactgagacacacacacacacaaacacttgcactcactctggctatgaaagagcttgtatcatttcccttttgcagatgatgaatctgaggcttattgttctcaaaatcagacatttttctggttatagaacagtcccaagttcagatattgtatctataaataccctgctctttttcatatgccagacccttacaagctgaagagacaaaaatgctctggacataaagatctacctggcctgaggacactaaaaagaatcaaaccttattataatggtcagagaaaatcctaaaggagaaatcgcctcttcatcatggtcaatacacagttcagcccaggaatatgattcactgttctaaattgcattgtcaagtattcaaaatcagtctcttatttctcattaccaattatagcagaaggttgtatttatagtgggggcatttccacatctagtatcaaggcagtactatgcctgacatatagaaaaaatgactttgtattccaaagggaaattttaatgtctaggaacaataaaagtgttagaatataaaatgtttacaaagaaataaaaagttcactttaaaagtttaacacaggtaagaatagctgtaattttacaacacttgttccttttcactaacgtttaaaaattttgtgcatgaaagcagaaaacaaaaaattgcaataccatcagcaattatattctactattactctgccatatgctgagaaaagcaagataagaatgttgatttatactttcacagttatttctgtgtttgtgttttatttctccaaccattgacacttattgagtgcttgtgacctatgcagttatagtaaagtaaaaatgaaaaatctcctcctggttaattctaaaacttcatagcattttgtacatttcactaaatattgaaagggacagctaattaagtatttggtctacaacacggatctatttatttatttatttacccattcattcattcattcactcattcattctacaggtaaagccttgctacgttgcccaggctggtcttaaacctccgggttcaagtgatcttctaccctcagcctcctgagtggctgggactccatatgcataccaccagagccaacttttttttgttttgtttttcatagagcttttcaaaacctacagaagaacaataacttatgaggatttgatgtattttacataagtgagagacaaccaagtcacaactgcatgtttaattacataaatgtatatgaagagcaccgaggttcaaactctcaaaaggaagatcaaaatcggtccctacatttgttactggggaaacggggtcactgctatgttggaaaacaaacaaacaaacaaacaaacaaacaaaggtcagactccaagaacaggatgacaagagaatgcttgaggaagaacaccaatcttgggatcaagagacaaggaagcatctctgctgctggttatgttcatggtatggtctgggtacaacagggaagagatgacatacaactatagtctatctgtagcccacacctgttgtctaattgtagacaactcttcagggctctgatacagcctaggaaaaatggaaattttcatcctctggcttttctccaacctccaaacctaaccctcacaagggtttcacttcctacttgttcatcccagtagcatagactcaccaattcaccataggccccaatactccctactgcctttccctcaaatcaggaccattttttcacttttatctggaccctgtaagcatctgaatttgtgattctcaaacttttatcccgtactaaaatggatattttttttccattttgcaaattcatttctgaaaacaactgttttaaattttggttctgtggcacacacatttacctttttatgatgattatcttaaaggaaacctctttctacatatgtatataaaagttaaatgctaagcatattatctaaagtcagtagagacacaccagggaaggaattcctggtgtctggaatatacaaataaaaaggttttgttttcatacacttggataactctaaacttctcagaataattagtctgttagcaatgataaaacctggtataaaaagtcaaatactttttattttatcaaataaaaactatttggaattgagcttttgaaactgactcttccaactggtcttttgattgaaagctaattttttaaataatatacttcttataatgaggagaatatttttcaaacatgtttgaggaatggaacacccaagaatcttgttttttttctttccaaaacgaaactagtattgagataattggctttttttttttttaattctgggtccacaaggtaaaagactcacaaggaaaaagctactattaagaaaattaaaattttggttaactttttatttaccaaactaaaaaaaaaaatatcactgtcactgaatgttaggtgggaaattttgttctgcatgtgattgtaaaagcatagctgtgattgaggattttaatagtgtatttttgttgttgttatttatttattgggaggcagtctcactctgttgcccaggctggagtgcagtggtgcgatcttggctcactgcaacctacgccttctgggttcaagtgattctcctgcctcagcctccccaagtagctggggttacaggcacctaccaccacacccggctaatttttgtattttattagagatggagttttaccatgttggtcaggctggtctccaactcctgacctcaaatgatctgcccgcctcggcctcccaaaatgttgggattacaggtgtgagccactgtgcccagcctttaatagtatatttgaaacatgatggtactatatttgcttaaatgaaatcacaaaaatgattaattaaagtgtagatattaccaattaagtcttcaaagtgcattaaaaaaaaaaaagcaagcttaaataattggcggaaaatgttttttaaatcactgtgtttcccaagacgatctctgatatttcacactgcttacagatctttccggatgtcatggaaaaatatttcctgcagtcttttcattatctctaccatgtcgagaggatattaacttttattttaaccaacatcatctggagactgaacactacaacacagtgcaaaaccaattggctcttcatcctctccaaactttcactagaaacttgaagatatgcaaacgtttacacctatcatcaaataaatccattcaagattcatatcagaatcttctcttaataagcctttaaaaaaatgaccaagcatcatattccttctcatttctcatcaccatcatgtgtatctatcaactcttctgaatcatattaaccgtgaccatcaaggttcaaaattttcttagtgaatacggacattttcctatagagaacacaagtgtgtagatgctgccaatcttttcttcaataaaggcaaattgttgtttaagcactatgggtacaaatacaaggcaagcacccatccctgatatcaaactgcacaccaagaagcatggaaaaacaagcctttatatagtactccctccaatgtgatagatcagccaagtggcatgaaagttacacctgccagtcaatctatactttcctagtgagcagagaccaccagctcatatacttccagatagctctggtgtttatggtatataatcctcttaaatgcatgtttgctgagacacagtaatgactcacattgtatatatccccacactacactattcctgcatacagccagaagctgctttaaaatatttccccagtcatattcatatacaaagataaataaatttttcagtttttcaccaagttttaaatgcaatctcttgagtcccatggttttatcacagaaaggtacacttcagcttaagaagggaagaattaaccattcaacttctaacaataacagtacactgaagacctaattcaattggcacagtctgggaaatgttcaccaactacacacaattgagtgatagaatgcaaaatacttcatgctttcttagcagaacactaaaatctatcagagaatgcaccttgattttgtcaaactacagcaataaaagtaaagcagcaaaaaaaaaatatgttcgctcattctcaaaaactgagttcgaatttttttggagggagggtgtggttctttcacaagcagtttttaatcaaaagtaagattttgtttatttgtttcaaatgtgtcaaattgctatgaaaaacagaaacaaatattaagctagccattgtgtccccacgaaaatgcagcaggtcttaatactctcccagctgttctgacaaccactgtaggcagcccttcccctctgtagacttggctgcattgcactggggagtagcatgatgtccacttgaaactgtattatctggagcttgcttttaatgtaattacttcaaaacagagaaaagaattaaaaggcagggttttttgtttttgttttccatgagctgatcctttgaacagctactgagaggaggacagcttacctgaattagaaagaaaagctcaactgttaagtcacttaccctaattaaagatcaatacagatattattagacattcattctacccatctaatccagagttgtgatgttacttttcataatacctgtatacacttactgccaaatctgttttcctgcttttcctattgtctttttctctattatttcccttcaccccacttttatttctcttcacagaaatgcccctgcatgacacatagtaacaaaagtcacagtccctttgcaagaaggaagaagcttgaatttaagcagttcttttaaaaattcaatatccaaagaaatactttactgtaacagtgtcattgctactccttagacttgttattatgtttgtgaaagttaattatctgataagatacactgtggttactactgtcacaaaaaaatgcatgggtatgtttattaattcaaagtgttccaatgaaataaagtgtgttaactaaagaactgaacaattatttccccgtaattattactgcacatttaggcgtttcataactgttttttttttttctgaatgaaaatcactttatatttaaaactatcagcatttacagctttgtattgtaaaagaatatgctattttgtccatatttttatactaaaggcccaggttgaaaaatccaacaatttaaattgaagatttttttcccctgctgtagaaaagtgtcaacatttgagcaaatcattaaacatactagaacaagaacctacaactaaaatgctgattatgattcatttcaaatattttaagtgttaagtcaacattcaatgcaggataaaatgaaatggtttgttcagaaggaatagttagagatctgcttactattctttctatttctgttattttcctgggataatccataaaaatcttatgtgaaagggaaaaaaagagaagatagtttaaaaatgaaagccataatctgaatggaattcgtatggcttcatatcagaaagcccttataggtgtcactgcctcataaaattctagcaataaaattgaagccaaatactctcctttcacagaaactacctttttctcaatatctaaaaatttgttctaagacaattggaagagaaaatacatgcactcctctagccaatagatctgcaaacttctaggtgactcatttgataacaggagacaaaattgtacaacacactaaactctattatttctacatcccagtagtttccagtataatgaatgtcctgtgagttttctgcagacatctagcagaacataactgccccctcgagtgaatgctacaccacctggattcaacaatacatatcactttggccatccatgacctccgccttctcaaactgatgtacgactaaaaacttaatattttcacactagcacaagcattgtgtcttgtgtacatacattatctctaacaagacacaagcattgtggcttgtgtatgcacattatctataacaatgttatttaatataattatacacaaaaataaagggaatttggagggccagtttgaaacaaaaccagaaggccaggcgccatggctcacgcctataatcccaacactttaggaggctgaggcgggcagatgacctgaagtcaggagttcaagaccagcctggccaacatggcgaaaccccatctctactaaaaatacaaaaattagctgggcgttgtggtgggcgcctgtaatcccagctacttgggaggctgaggcaggagtatcgcttgaacacgggacgcagaagttgcagtgagccgagatcatgccattgcactccagcctgggcaacaagagcaaaacgtcgtctctaaataaataaataaaacaaaaccagaaaattcaattttttttccatcttgtttcttaaatccaaccagttcaacatatcctcatgtactggttaagcttccctaaaccaaaaatctgaaatccaaaatgtttcaaaatccaaaactttttgagcactgacatgacaccgaaagtgaaaaattccacatctaagtacttaacagaaacttcatttcatgcacaaacttatttaaaagattgcataaaattatctctgtgcaatgcatataagacatataaaatataaatgaattttatatgaaatttcacatacatgaaatataaatgaaaggtaaatataaaatataaatgaattttgtgtttagacttgggtcccatccccaagatatctcattatgtatatgcaaatattccaaaataaaaaaataaaataaaataaaaatccaaaatctgaaacacttttggtcccgatcatttcagataagaaatactcaacctgtatcataattaccctgattctacaggcaattaatgcagtttcagtaagaaaattaagaaaatagggagtctctctgagcctattctggcttgagaagttgcccagtaaaaaataataaaaataaaataaaaactaagaagaaataaaatatacagatcactaattagaaaataaactataaatcatggggttaagttggtcacttttaattttttgcaaaagtgaagatacccaatgaccactggctaccatgttgtgctagtgtaaaaatatatcaccctggaaagaaattccagtggtaactgactcttttagcaccattttactcaatgtaagcaacaccaagaacagtgtcatgctacctaaagaggtactaggtctgaagaaagccacatgctcatttattctttgtagtaaaatctattctttatcatcataattattcttctaacctaaaagaggctttaattagatgttcaaaaaatagatcaaattaggtgaatattcaatttgcaaactcagccaaactcgacaggtttcattctaattacatgcagatagatacatggagacacatatgttcaccacagttttccatgtgcttcctctttcaggcaactgcaagattaagccaaactgtatggcaaagcgttccagaaagtaccatcttacatagaataagataatttctgatttttaatcttaactgtaatactaagagactgcatcaaaacaaagactagacgatttacttgtttaaaatgtcaattatataaagagatggtgaaattactactagaagaaaaaatgcaggccgaaaacaataaaaatagtgaaaaatatttggaaaattgcaatgtatatgcactgtgttaagtgattcataactgtctttcaattaaaactcgaatctttactataatagaattccaagagggattttcttagtctcaaaattgtgtctacaatctgaaattgagaacaaaaagtgcaaagtattccaaaagttagagatagcttgcagtgagcaagccagaagcttgtgggaacaattacataccttgagctcagaccaaaatataccagagcagatcctgctacaagtacctcccctcagcctgtccaccccttccccagctgtcacaagaagaggatcaaagaggagcactgaacagctttgtggggagttcagcggagagagagaagactcaattctctctcctctctatgggaaaggggagggaggtactccttgccccaaagtgatgaggtttcaaaatcagcactcagaagattagggatgcatgtaggcagacagtggcctcttattccttggttggatgcacacagccccactctggtactgttactagagggtagcggggtgaatttcaaggagagcttccagagagctcaggaatatggcatcttatctgttttactccccctccactatggagaaaagaagtttcttaccatgtatctcctgaaggctggggtagacctgagcagagagactggcgctcacttctgctatagagatttctgagggtataagacccaatatgcagtccataccagaaagacagacagacagtggtgaggtgtaccagggagaaggatgtgggaaatcccatccctagagtttgggttgggggctggaggaagtccctagtattttccattctcccatataaaaagacaccaaggttagtggaaggaaataggctgctgtgctatccaagtcacctcaaggagaagtcgtggaaaccccaactcatgcaaatctggaagtttcaaagagagacaaggaccttttaggatacagtaaattagaagagtaagagtagagaaataggtttgtccaagaaccaagtgagtgataatccaggaaaagtaggctggagtcacaaggtgggtcacctggaatgccagttaaaagaagtcatagaggttatgaataacgtggaggttatgaataatgtagagcctgtgaaggtttgaagctagagagtgagcagtactgtaggaaggaggagtgggaagttaatcaaatatcaagcaagaactttgcaagtccctgtgaaatgatgtcctgctttctctctcctctcctacttgtgccaaagaagttcagattgctaaagagaaagattataggggtcggtgttttctgcctctttttttttttttaattcatcaagtaagacaagtgagtaaattatcaaaaatcactcagctcactaacagagggacagttcactctttgaacccatggttttcttctctaaccccttgacttgggcaggaggaaaaggcatcagaaaaagatctacttatttaacgaaaatccctaataagacacaactgtattaactttaggcattatgtggtacattagatatttagacttgttcgtcctatatatctgctattttgtatcctcttgacctatatctcccatttcctttccctcccctgacctgtagtaaccactgtttcattctgtatctctgtgtattacatccattacacagagaatgaaacagtggttactatagctatatcagcttgaatgtatggattatagtctacatgtaagtgagatcatgcaatattttgctttctgtgtctggctaataagtagattttacctgcttttgtcagctaaaatatgtgagatgacagatgttaatctgcttcacaacagtaaccactatgctatctatatgtttctatatatctataagtatcccatactttcgcgttctaaactttaaatatgcataataaaatttgttttttaaaaatctattcagttgacagaaatggatgtcatttacagtgttccaaaagaaaggatgacaaaaagagattcagtgccccaatagcaagaagacaataggtcacctgccaaagcactgaagaactaagactaggggtgtggatgaccactgggtatgtgaaatgctacagagaggcgacagagaatgagacccagtaaaagcacatttctttcagtagttagagaggatcactggtacatttgagagagcagctgagtttttccggaggaagacagattgaagggaagtaggtggtgaagaattaaggcaaaaatttcttgaaagtgtgaggacaaacacagcctgtgtgtgtggatgtggaggtggggggaggatgtttccttcacttaatactgtggcaatagagacattcttgtatattccatttctacctatacagtgtgcttggagagtatcagcttgaaaaaggaaagtgaagaatacaattaaacaaaataaagacaaaatagaaaataaatgtattctaaacgaataacccaaaatttgaacaacttaattttgcagaaaaatgatgcgatacttctcatttaattttttaaaaatatatgcaaggtatcatccctaaactaatattcactaaatgaatttaaaatacaactaaagtaaaatgagagtggaaggcatataaattagtaagtcttgaaaaggtgttttggaaaaggggaaaagtaacaatggtaggaaatatgtatcatgtaaattaaaagaagcaaaagggaatgaaagttcgcccaggatacagaacatattaaagatacttttaaagcttattgctgtaagtatacttttaaaacttattgctagaattttcctgaatccattttctaaactgtaaagcagtttagaaaaaaaagtccactttttaaaaatgtacctagccaaatattttatctgtaggaatcagagaaatgcctacactgaatacggaaatacattcacttccagtaacctaaaagggcacatttaaagaggcatagacctaaaaagaaatctccagaaattattttttacacacctattgcttgaagagactgctgcatcaaaagctgcaacttacgacttttagaaaacacgccgcgtgcctttcttgtggttccatatgaaagaactgtatctagaaaggaccctatttttatactttgcactatttgtcctgaatcctttgaaaactctcttggacaatttcaaagatattggagtaactaaatgttggaaaagatacattctttacatacatactcaaatattcatcaggaaaggtaaacatctcacgagtccataaacattcatgggtacaaaatgttttcattcacaagttttcattcaaactaaattaccagttaaggctattatctcctcatacatgtgttaaattatctatttgtgttgtaccatctttttggttgtttactgttcatgttcatgacaatttgaagtcaatctaacactaataaaacctttgatgtaaccttcttggtttaagttacctctagatcttcttaaatccatttcttcgctgagacgtgaaaataattttattagtacagaagctctctaattaaacagaatgagattcaagtagtttatgcaaatgggttttcatcatatgataccaaatgcaaattaaagggaaaagtcacctgagacagacattaattttccccaaaagaatttgacactacacatatctacaaaacatattgactaaaattttcatttcagaccttcaactttgtctaaatgtaatctttcgtgctttattagggttgggcaggatgttacagatattaatagtgacatgctagggttccttgtaacacacatttaactctaccttcttataattactcattaatttgctatttcacttcttaaaaatattaaaaagggtgtaaagttagaaattgaatatcctctaatgaacaaatctccagttattaaatactcttaggaaagcaccacttcacaaatagatgatgtcacatactgtccctgaaatagtattcctttcagatgaacagataaaaatggcaactgattatgaaatttttagttaaggacctaaatataatgtccctagttagcaaggaacatgtaacataccttcattttccaacatcttaatttttgtactctgtgtggggggggtgggtgggtatgtgggggtgtatttttagaggcctaaatcctctcaatctttctgtttcaattctgccaattaaaaacagtagacacagcaaataaatgtaactggaaaatttatatggaaaagaatcagaaacctcctatccatttcctatattaaaatgagcttatcaaacctgcaaaacttaggtatttcataaaacacttgattttttttctactaagatatccttacacatcttaccatagatatttcaagctaatttgtattagctgatttttttttttctctgagaatatcagatcatctctcaaagtatttttctctatgaaacacagcggctgtctccatttaaaggaaaacacacacatacgcacagctaaaggttaactgaaacgtaagtagaaattgcacaaaacaaaatttgaagcaagttatgacctctttctcatgttgtcacctattttccccatcctaagcttgagttggctccatctgcctaattataagcttaaaaccctctgggtggtgactgagtctatattctgcactgcacttaacacatttttcatgctctataaattattaataataacagtagtaatagcatatacttttcctactataaaagaaaatatgaacctcacaactgccacttatttacactctcttaagccttccagataacagacagctgggtaatggttactaagatgactttgcctcttccttctattccatttttaattctccttaatgtatctcatttatgtttttctctttctatatttttaatttatccctctaatttcttgacctcgtatatttattctcttattctgaatgcaaagcagcaccagtattttttaatttagctgctaaggaaaatatctctatttgtgtatgttcaattggcataacgagtgcactgaagtagtgtttctcaactttggtgctattgacattgggggctgcatgatttgttataagtgctattgacattggggctgtcctgtgccttgcaggatgttcagcagcacccctgacacccacccagtacatgccagtagcacatcctgccccctattctgacaaccaaaaacgtctccaaacgttaccaaatattccctgggaaacaacttccccaccaggtggagacccactgcaatatggtaaaactattcccttcactgtgtcacattgctggagctaagacggaataaagatgtgataaatatgaaatgggaataacaaaaaatcacatagacacacacacacatatacgcatccaaaattattttgaatgtgcaattcaagcatttaaaaagcctgaagtttggctcatgcctgtaatcccggcactttgcgaggccgaggcaggcagatcacaaagtcaagagcttgagaccatcctggccaacatggtgaaaccccgtctctactaaaaacacaaaaattagctgggcgtggtggcacacgcctgtagtcccaggcactcaggagactgaggcaggagaattgcttgaacccaggaggcggaggttgcagtgagccgggatcgcgccactgcactccagcctggtggcagagcaagacgctgtctcaaaaaaaaaaaaaaaaaaaaaaaaaaagcatgaagttaatacaagcaaaaataagtaaaattccaatactaaggattatttgatggctaaaaaattagttctgctactttacttatgaaagctaacctggaagagctctaagtaaggcactagctgtgatttaagaccagtatgttttaacatccaattaaaataaatccttctaacagcacttttataaaatcacttagcttgttaaaacatataaaatgtttggctcccctgggctagattatgattaaggtacattcagagaggaaaaaaatgcttctcatttcacaaggtcacagtccatttccaaatgagcttatacttcactattttccaaattgggttgttttttgtatgtgttttttgtttgtttggggtttttttgcttccttcactaaactagccaaggtcctcctacttctgagcattactgtaaatctagatactgtcaaatagcatttaatctccaatgaattttaaaagccttgtaaattacaaaagaaataaccagggtatatttttttttccttttaagttttctctcctgtggtcagtaaatacatgtcaacatccaccttctttattttaagcaccaatgcagatagcattaagtggatgtcgcatacacttgggacatatgggaagcctcatgagataatgtttacatgcttgagatccgcagttgattccacccgggtttgaaatctggctcccaacctttctcccctatgtgtctttgaggatgttgccctctctaagcctctagttcctcaagtgtgaggggtggaaatttttgtacctattttatggaattgctatgaaatggaaatacaaaggttttatcacatatcctgcagagtgagctgtataataaatgttgactattacagattcattaatcaatagatgagcttcaacgtaagtattgtctcacgcaaaaaccccactcctccccctcctaaatctatgtaatcctgtatttctttatgtcatacccccacctccaggtacacactacacacatatgcacacatacacacacacacacacacaaaaaaaaaaaaaaaaaaaaaaaaacctcacgcctggcaatcctattccctccatcacactcaatacctcaagttcctatccaagacatgatgaagccctgtgcctccttcaacatcatcaaaacattccagttactaagcttgtggacccatcatctcacgtcgccttcaacatcttagacagatcttatctccatcaccttgtctccacccctgccgtccccactctgattcagtctcttgccttctacaaccagggcaattttagaagcattccaacttatctatatttacagtagcatccctactctgatacactcttcatagtgaagtcagagtatgttttctaaagaacatatcccatcattacttccctctgtgacatactgcaatgtgctcctggtccctgaccttcgggatcaactccaaccctcagaatctaacaggtaagtctatttatgacctgagccccgtcgttctatcccattttgaccaatagtgagtgcctttcatacaaacctatacaataaccacagcaaactatctccaggtccctgaataagtgacattactcctaatacttttttgtatattaagactgttgcctggcatgtaaatctccatgcatttgtttgcctagctcactttctagacctcctttaagcatcaccttcttcatgaagcagtttcagaaccctctgaggctgagagatgctccttcatctgaattcccttcttacaactccctaagcccaccttaaggagcttaccctccattatagtagctttctcatctatcacacccaccaaaattcacagccaaacattagctcattttcatttttttttttttttttttttttagatggagttttgctgtgttgtccaggctgtggtgcagtggtgtgatctcggctcactacaacctccgccgcccaggttcaagcaattctcatgccccagcctcctgagtagctgggattacaggtgcctgccaccacatccacttgatttttgtgtgggtttctttttttgttttgattgtttgttttttgatggagtttcactcttgttgcccaggctggagtgcaatggcgcgatctcggctcaccgccaccactgcctcctgggttcaagcaattctcctgcctcagcctcccgagtagctgggattacaggcatgcgccaccatgcccagctaatttttgtatttttagtagagacagggtttctccattttggtcaagctggtctcgaactcctgacctcaggtgatccacccgccttggcctcccaaagggctgggactgcaggcgtgagccaccgtgcccggcccattgtcatctatattttgttgttgttaaaaaaacggagtgcttggcacacagtaggcacccaaaataagtctgtaaaaaagaatgcctgaatgaaatgaacgaataaagtgaatattaaggaaattaatcgtttcatttagttataaaaagccataatggacaaagacataatcaaacggcatttttaaatggcttgcatacctaagatagccataaaggatgttgcactttaataaaaaattaaagatctgaaacacagaactgattttcaggttccacttaataatttctaaactggaaatctcaacaatcaaaacatgggagccgtaaggatgcatgcacacatacatttatcacagcattattcacaatagcaaagacacggaatcaacctaaatgttcatcaacagtagacaggataaatacactgtggtatatatacatgaggaaatactacccagctatgaaaaagaatgagataatgtcctttgcagtaacacagatggagtgggaggccattatcccaagtgaactaacacgcaggaatggaaaaccaaacacctcaagttctcacttataaacgggagctaaacattgagtacacacaaacacaaagaaggaaacaagagacaacagggcctaattgagggtggagggtgaggagggtgaggatcaaacaactaccaatcaggtattatctgagtgatgaaataataagtacaccaaactcccgtggcacacaatttatctatatagaaccaatctgcacatgtacccctgaaactaaaataaaagttttaaaaaatgtgatagccagattattatcagaaaccagcaaggcataaagtggaacatcaagtaccactttaatagcaaaatgtctgatttccccatgacaatctgtagtactccctaaattattaacagacccaggcaccacaagcagcggggactcacttgggaagcgagcaacacatttatttagttctaagattgatgaatcagaggaaggggaaagcagcagcagttattttgatctgtggggggtcttggtgccttttgtatctcagcctctgctggtgttgaggctctttgtgggtgcaggcctgcaggctgcttgtgtctctctctcctgctatctctgctgacagcttctctgtgtgacagcttggaatcccggcagtgaagtgtgaaaataaaacacaggcaaaactttacatgggaatttaaaattggagttatatttttgaaagttttgaacgcattaaacatccagaaaactgcttccttgttagagcgcacagggaaggaggagtgaacaaggtcaaatccaattcagacatcatttcacacgaggctccacaccaccctcactgtccttacgaccccgggagtcctagattaaatgttctgagtcaagttaatgtcaactatttgaccttttcaaaaccacggttttccaaaagttaacatctaccacatcacacttatgttccttctgttacatggtttgctcttttaatagaagttttaaaaaaactttgtcataatctaaggagatgagagaatctatactctcttgtctcttcttgattcagtcttctctcccccagcccccttcactttcagggcattccagaattcaagtttaacgagggcaaaagacagtcctgccaaagtcaacaatcaatacttctcaataataaaggaaatacagtattttggcccatatttgctttctataggataagattccaaaagcgaagaggaggataattatcaactccaattccccaaaacctttgtagtataaatgtttctgaaaggcactgtgttttgcaatggtttgatagaacaaactcccttatgtataaaatgacatatttttggccacagatacataaaaacacagaacacatttatatccagtctaataacataaaattgatggcatggtttggaacctattctctggattaaaagtagggtccagtagtagaaagggtgatttaaacaacctaaaataaaatgctttggtaaagaataaaatgtttcatgcaaatatgcattaataatactgtgccaataatatcgagagcagttcatgtcacaatgcaaatcagaaaaacaatctcaggaatttctgagttaaacagatgaccctgttcgaagtacatagagggttgggatggaaaccgataagaaatggaaggtggtagtacaggaatagcaaccattagcctcaacagcctataaaaaggattccatctttagaggcagaaactagtcgcttcctactgaatttctggaatcctaaaatgatgcattctcatctagcatcatcccacaacttcaaagcagtttgttcattatcatgcaatttcagcaaatcacatcctcttgatacgatttctgatctggaaattcagatatttaaataactgttctccaaattcctatttctaaaactgcttcaaaattcctaaactttcccacagttatgagaaaaatgtgtgatccttgatggtcatcacttcatattcactgtgattatctttgctctctcagagaatgatgtcagcaaaagtttcctttcaccacttgcgggtatctatgaaactacaattttacacaggatgcactgtcagacagcatagaacgccttcaactcctgaggcaatgttgctttcaaattgctaaattatcttttaaaagattcaccaattatgttgcaggaaaaacacatgtggtttagaatataaatatttacaacagatactgagattcagaggtgaaagaatgaatagtgatgtgatgttttctcccaagagacatttgccatgactgagaccactgccaaagaaagctttgttctccattccctctgtgttcctgcctgctgagctcttcttccactagtcattacaactacttctttggatagcttatgactgttgagcaaatatggcatttgtgccttacaaagctttcaatttaacaaaaatttctcaaatgcacaaatgtactaattctaattaccaatatcttatatttcacactgcatgtctactagagaaaagatcaattggccagaaagcaaattaatctcattaaaatccttaatgtaatccagtacagtaacaaggagattaaatgtaatattgaaacatttcttataaatcatattttatatattagatactatgattcttttgtttctactgcataattacacatatatcattttgaataatttatattatctatttaaaatctatttaattaatcaagagaaataaaggaaagaatgaaattgaaaagaaaaatttatctaaaagccgtatgtaagaagcaaaagcgctaacactggaaaaccaatgttgaaaagaacccacagttttcaatgataccacctgttcctccttgaaagctaattaaaatacaccttaggaaacataattgcctacagctttaattacatctcttccaagaataaagggctaccactcccaggatatgttttctcactcagctactggtgtgtcttctctcgtgttgaatctctttctgacatcataagtgactgcccacctttccatatatgtgcaatcatgagattcaaagcctgtatcatttcagaacctagtaaattcaatagcaattttatatttatacctatctctacattgagtatatatacacacaaacataatgtacgtacatctatatactatatatgatattaaatatacacacacagctacaattatactacctagcaaaatacagatactatataaatacataaacacacatacacacataaatacatacaaatatgcctatacttctatatctatgtctttccattaccagaacaaattatgatatgcatctgttggcaaatacattgtttgacattcagaactaattttccactggaaacaatgtcccagactagcccatggcaggcttacaaatccaacatgtagtcgaatgattggcctcacgggactgatttgagtttcagggccctggaagaagatatgctgtgaaagcagcagcaacacaatggaggataggaaagggaagaggagaaagaacacattttcctatatttcctaggttcaaaaatttgaaacagtcactttttggtattcctcctctcccttccttcacctatctcctgactttgttagtgccctcaagtgtcctccacattctgcctgtggccctctaccaaggttacgtcattcccaatcacgcctcatgccaacacatccacagcttccctgatcaatcatccatagacgcagacactcagtgtagatgaactcttttagatgttagaaatcagtttttagttaatggtaaagtccgtataaccaaagcaaacacattttatttacatgtttgtttcttaaagaacatgcttactaatgcaaataagaaactgagagaactatagctagcgaagaaaaaaaaagaaagaaaaagagagggcatagatgcagtgggttacagttttacatattttggaacaggctagtttgaagcaacagtttaaccaagaagctgctagaacttgagataattctgttattcccagccttctctttttccactgagagaagcaccatgtctttaaaagcttttgtccctcaatctgtacctcctccccatctccatacacacacgtatctagactgcttaggagaagcttctccaaccaagatcaggttagcagcagaagaaagtggtggtgcaaagccgccagccctgaacgatgtgcatgcgtcatatagacaagttgcttttgtagagataccccactgcaaacattcttttaaagatgacctgaaaattcccatccttgaatataaattcatttctccactgtcattattgtttctagcaaactacttaatataaaaagcaactacagcaataagaattcagtgattgcccttccccacttaaaatacataatatctactgttttcattattacattcttggaaaccagtacattacttcagctctaaaaggtgctgaacaaccgactacggtaggagaagacaatggaaatctccaaaaagttctacaaacatttcccacaaaacatgcaaggattttttttaaacccttaaatatgaaaaatcacttcatagcccacatttatgaacatatgtacgtaaaaaattcaatgagacagcaaaatagcgatatagacacctttgtcattcagtacaagctaaccacacaatgtgcagaatgtatgtgactcatcaaaacataataaaaatgcattatgcattaggtaaacaacaaatagtgtttttgcacgagagaagtctaaataagaatgtaaatttatttattaaacctcttcaatgagacttcgactcctaccgggatatacccattcttagcatgacaaacaaaaactaacaacaggagttcccagggaggaagcctgaacttgggctttaaataattaacacctttcaaagaaaacataaatgtttggggggatacatatccaaattacaccaatatcacacgtacccccaaaatatgtactatgtcaataagaaataaattaaaaacccctgtggtacacaacatatacatttttgcaattaaaaagaaaactatatgaaattataaaaaacatttaaaaataattaacacccttttttcccttaatttatgcctatggcaatttgttgttagcagttaagccaaaatgttatcctagtgtagcaggtgatgtacaaagctctttcttaaaacattgaacagaacatcacatttaaggaaaattaaggaggctgaaatgggggaggtctgagtatattttcattaaatatcaaagatttagtaatactaattacatgttttcttcccactcagttaagtgtataaaacagatattcactattttagctcttctaatgtaggcctatcataggtttttgctgttcctttctgagttgttgtttatttttttgtaagcgagtttctgctgttgctattttgttttcagtatttgtttcaagcattcaagactatgacttgcaggtttcccaaaaaaagtgtctaaaggcttttaaacctgggttctagagagatgagttttaacaataactccaacagttaccttaatcactgccttaataggtccacatgattttccacatcttaacttttgtaagaggaatataaaaaaagagcagcaggcttggaagaaaaggtggatctggcttaagaaggcataccacttttgagtgccacacacaaagctgtattttctgcatgtgctgtggtgtctctctgaaggaattctcttcaaatctgactttgcattcatgatttgactgtcaggtttgaaagcaaaatttatgaaaacatagggagaatataagaccctaaaagttaagcttctttgaaaaatgttaattcataacttggataagcctctctctttcatggagacactcctttctcaaaaaaaaaaaaaaaagtgtatacataagtgagagagagagaaaaggaaattacagaggacatcagttgtttgcaaacagttcacttttttcaggctggttttaataagcctccaattcagctccaacctgactctcagaacccacctcctctatatgtcatcaaggaaaaggaggaagaaataaaatttaaaagtccttcttgccagtcctatggcaggtcatattttccaaagatgcacatatctcacgccataaggtctccttccactagcagtggggagtctattccctccatttgaatctgggcacagggttgtgacagcactggccatagagtatgctggaagtgatgctatgtgagttcccagctaagtcgcaaggagacacggcttctgccgactctccttctggcagtcttcattctgccttcttcccttttcttccccgaccagaaccaggagtcctgggctaagacgtaagggttccaactactccgaagctgccatgctagagagaactcatcaggagaccaaatacagacagaaagggaggtgtctgaggagtcctaactgtaccagcagcgaatgttcaagaggtcccaacatcaaccagtgggcttgtgagtaggtaaggtcagaagactccagctacccacccctccttagagtcttctcattgcagctaagatatggtggagcagcgaaaagtcatctctgctgcgccctatctgaattactaacctatagaaatctgtgatagtaacagatgtctttttataagctaccaacgttttgtgtcatgtattatacacatacagaagctgaaacactcccaatgtgattgccagcaaacccaattctctgcaaaataaaaacaagtattatgtcccaagaactatattttgtatatcatcacttctcctcacaatgattttgtaagccatctctattttacaaatgagcaatactgggctgggagaagctaataaggtgctcaatgtcacacagctgacaagtgaaccaagattggaacccaagtccctctgactgcaaaccccatgatactcctctttccttcaatgatatccctctttctttcccctacaagttcacactgcagaggaaatcatgtgactaaggtctcagttatagtactgggctcagtaaaactagcctcactcatttcttcctttccaactaacctacactgaatcctatcatttacagactaatacacaaattatagtaatttctatatatgttgaaaaataataaaagaatgagggagctatgttaagattgattaacaggaaactatttacaagaagacacctatttagaacaatattaagggtgcctgctgtgttttgattttaagggttacagattgcactttgacaaaagtgcttctacgaattataattatattcatttacttcccaatgaatattttcattcaaaggattttactgctctctgtgggcatatgattaatatgcatgtgctcaaacaatattcacaaacttcacaatcctagagagagaaaaaacagtgatcagctttccccagtccgagtaaattgctttgagtgaatttctgcacctgtaaagatgctcttctggggatgggctgtgtttgcatccggggctggatgtcaagatgcccttctgtcctgatatttttcaagggcaacagcattacattgttattccaatggacagagctcataaaaagacatccttatattctggagcctttaggagaaagcttttctttggcagtgaatgaaaacaaaggcaaaagatgaaaggaaccatctttcaaaggaaacaaaaaggcctctacaaagaagtgcataaatgtagaaagcagaaaaaaaaaaaaggtacattatatttggcgtgagagtagagacaaagcaaggcccaatggagcaatactctttctttacaaatactgtcagaattttggggaaaaaaaaatcatttttgaaggttccaggaacaaaaccaacagacgagagcttaaaatatacacagccacaatgtttccattttgttggagtttcagaagaactcctgtgggcaaacgctgcatgtaaaacagactgggtgtgatgtaactatatcaaggcaacaaacacatcaggaacagttggaaaccagccaatactttggttttatataatgtccatcaactggttgggctgattttttaccataaatggcctgttttaaaactgactgaacagtggacttgaataaatagtgtaccaaactaacaccatagagaaatatacagaatcaaaggtgttcaagaatgtcaagcaacagcacagccacagaagaggtacaggccgatattaataaaccaaatctaatcacattttcattttccgactgaaatctttcccaaagcagtacctttacatacagtgctttttgttaaaaataaataaataaaaataaaatgccaaacgagcactaggctcctctttattatgtctttaaaaataaaagactcaagccagattggacagttttctttgaaattctagtttcagctgctttcagcggctcattttgagaaacatctgtccagtctggctcttggggagatgttcaaagacaagtgttctcatctgaatgctaagggactctcctaagggagtcaacagtcctctgaaagcaagcagaaactatcaaaacatctataacccttgaacttctttatcaagttcagtgcacagcgtacaatatgactcaatttcatctttagtaaaaaataaagtttgtctgcttcactgccacctttaagacatcatgttgttttcatattaaaaacttaaaatattcagtgaccaattaatttggaggcaaaattggccaagtataaagttatgcaggggagaattcagatttgaacacagctaacttggaatctgagttcatgtacaacatatgtatatacaaacccacatgttgcatttgtgaatgtaggcacagagtgaaaattctccatgtttaggtccacaacacagagccatgtcacgaagaattaacacatgttctaattctcaccagaagtgatccaaataggttaatgaacacctcctacatttcagatataataatatacattgtcacaacaatttcataaagtaggtaatagctccattttagaaataagtgaaggggggtcaaacaagccaaaaatgtgtccatgttcacatagttgcaactggcaaagctaggatcggaaccagagttattttgactaagaggtccagaaacttggctctaccaagccaccatccaagtagaaggttaccaaataccaaaatgaggaaatggtaaaatattatccatgagtcactgaaactacataataaaaaggaagccaaaataagttttgacgcatttaaagctaactctctaaggcatgggttaaaagttgaaagctagctatcagaagtttaattttatattctctcaagtaagagaaccaaacaaaagtagatcaaccagaccaaacttttaaaacactttaacttctctatgaagctaatgtgtaagatatggtatttcccccgggggagaagagcctgtgtaacattgcttttcactctcatgattgaaagaaaaatcaattaaaattatcctgggagacctttcataccattccaaagagccaagaaaatgctggatacattctgaatgcagcaaacactagactctcctaaaaaatattccacatatattgtttgctaaatcaaattcagtccttagattttacaggtttaagagaatctctggaatacatggcagaaatcagaaaaaaaaacaagcttatcctacatttggtttcaaagcgctttctttcaagatctcccaatttttctatgttaaaatttgtgatggcttctctcaaaactctgccagaaatttatgaggaatgaaaaaactcttctaacagattcagaaataaaactatggcattttcaaaggaaaaccaatatgaatgccttttaaataaagtttggtaaggacaacacaaaccgtatgttccaggtatgtgatgtgaaccacatggtctgtgaggcttcttgcacttgatatgctcctcctaaggtgccaacatcaacaaacaacaatgtgtactgtgactgaagttacagccaaggtcggatggaagtgtgggctctgttagccttgatctaattttttaatgtcaagcaagaaaactgacattttggggtacaatattgctatccaaagcaaatatgtggaatggaaaaaaggcaaatattaaattctgaagtaaacaaaataagaggtccttaggtaaaataagagtttttttttttttctcaactagtctccttttctcagagtaagtttcacattttatatactactcatattccctgagaactttacgtacatcagtgtctacatttggagatgatgaggttatttgatttaaaattgagaggccttggttcaaatctttgtctttgataatctatatgtataatgtcccaaataatcagaaaaataaacaattgagttatatcacttttacagttttttgaaattctgaatgcctacaaaattattctttattacaataaaaagttcgctatataatgacaatatgagagttatgtggcttaaaacaatttttatttgcataaatagtcatcctagtccacttacttggcgagtgatcagtaatttacaatgctgaataaatgtatcgttttcataagggacagatgtatttttatttttccttcttatccttctcatttcccttatcccattattctttcagtacataagatcaaatgatgaatacactgagttatccagatgtggttcaaaaaggaaaaatatagccaggcgtggtggctgacgcctgtaatcccagcgctttgggaggccaaggcgggcggatcacaagttcaggagatcgagactatcctagctaacatggtgaaaccccgtctctactaaaaataccaaaattagccgggcgtggtggtgggcgcctgtagtcccagctactcaggaggctgagggaggagaatggcatgaacccaggaggcagagcttgcagtgagccgagatcgcaccactgcgctccagcctgggcgatagagcgagactctgtctcaaaaaaaaaaaaaaagaaaaaaatatatataagatggtatctggatagcaataagttataaaaaaagaaagttatgtaagaagaaaaacatttagtaaacacgtattcttcaggtttcttattcataacacacaggccataataacccttgcaatggatacattctttttgtagaacaccaagctatccatccatagtcaaatgaggttataggagatttaccaaaaaatatacatcaaactacattcagtctcaattttctcatccatgaaaaacgaatggttttatccaaataatctctaaagtcccttgcaggcctatgactttatcactctaaacatctatgcctgtattcatatcattagtaccatcaacacacatgaatgcatttgaagaatgttctaaattttataaatcagggcatgagaaactaatacaggggcaaaaaagaggctcttcaaaattatggattagaagcaggatggattcattaatgtttttaatttcactcctcctgagaaatggagatgtctaaatcaggctgggcaatcactaaagtgactctgagaatcatccttacaaaaaaactttcttgttaaaatacagcaatatgattccacctctaattgataccaatatcattattaaaaaataaaaataaaaaataaactgtgtggatagaaagatgaaaacaaaatcagagtaagagtatatgactacagagaagggaatattttccctctgtactaattagttcatttcttgctacctgaagacttactgggttaatctgtggcaccacagtgtagtagtgtttttacactgctgatgaagacacacccaagactgggaagaaaaagaggtttaactggacttataattccacatggctgggaaggcctcagaatcatggtaggaggtgaaatgcacttcttacatggtggcggtaaaagaaaataaggaagaggcaaaagtgggaatccctgataataccgtcagatctcgtaatacgtattcactaccatgagaatagtatggggaaaccacccccatgattcaaattatctcccattgggtccctccctcacacatgggaattataggagtacaattcaagatgagatttgggtggggacacagccaaaccatatcacacaggatgtaatatcctatttggttcatctcttctttagaatattactgtttttctacactttgagtgaagagggaatacttatttggatagaatatttaaaatttgggccaggcacagtggttcatgcctgtaatcccagcactttggaaggcaaaggcttgtggatcaactgaggttaggagttcaagaccagcctagccaacatgatgaaactcccatctctactaaaaataaaaaattagctgggcacagtggcatgtgcctgtagtcccagctactcaggatgctgaggcaggagaattgcttaagcccaggagggggaggttgcagtaagccaagattgtaccactacacttcagcctaggagttacagcgagactccatcttaaaaaaaaaaaaaaaagaaaaattaaaaaaattcctctcctaacaattctaactccttctgcaacaaagtcacaaaggtaggatattttttcacatatatgactttacataattttcttctttaaaatatttagatttggccgggtgcggaggcttgtgtctgcagtcccagcactttgggaggtcgaggcgggcagatcacaaggtcaggacatggagaccatcctggataacgcagtgaaaagctgtctctactaaaaatataaaaaattagccgggcatggtggtgggtgcctgtagtcccagctacttgggaggctgaggcaggagaacggcatgaaccaccaggagggagagcttgcactgagccaagattgcaccactgcactccagtctgggcgacagagcaagactccgtctcaaaaaaaaaaaaaaaattagatttaatcatatggtcagtaatttatccataggggctaattttattcaagagaacacaatatgtttctcataaaatggagcaaaatgcccaaaacgatgttaaaattaagaaagaagatagtaggtaactgacagaggggggagaatgaaaaacaaaaaatgtagagaaaagacataaaaaatattaatttcacaatagtgaaatctactcttagtgaaaactaagaaaactcttttagcaacttaaaaatatacaggacattacttaatttcaattttcaaaatatgccaaaggactttgaatattcaagtacctagacctcccttttaacagacaattttaatcttgaatattaagcagacttaataattaagtggaaaaatggatttgactggggcatttctgtcttttcctccatcaagggaggtattagtaaatttcacaaaagtaagcctctgagaacatgtgaaagaaaaaattatctttctctcctaagagttcagaatggaaaacaatttgtaaactaagaatgagaagaaaggagttcaaaaaaataatgaaatggcttttgacaaaactattcctcgtggccacatccccgaatattccccatggccactgttctaaaatatgtactaactcatttgattcgagaaggacctaagggagaagagaaaaaaaaagaaatgacattttgattaaagaggtcgtttatccaaacatatgcgtatccactattggtttcttcctctccatcctactgtgctgcctccaagggaaacaatttctgaggagagtgtctacagtaccatgttcagaaggattctgaggctgttcttctctagagaaaaaaaaaaaaaaatagaagagtgctattatcaaatagtaatgtctgttttgaacaagggataaagagagtagcagcaacatacaaaggagaaaaaaaaaatgaacaaacctctcctggttggtcagaatctctataaatcttgaaatttcacaagtcttttgaaaccttcattacataagaattctattggatttgaaggtgatttgcctgaatatacttattggtacaaacagcattctgaattatcctttgaggttgtaaaatagtaaccagattccaagaggccaaacaatttttacctcagtacttgccagctttcttaaaatacgttggttatgacttcctttcacattttcaatgtgatgtgatcaaatcctcctgtaatctaaactaactttataccaaaagcaactttatgcaactttattttattccttcatattagtcccatctcacaccaagtatatactggcttgcatttcaacaacaaaagtcttgaaatagtgccattcaactcataatcatgttggtttttccttcatacctcctatttctatcattctattgcatactcactgggttcagaactgagggcatctacttcctggatttttactattctccctttggaaaattccgactctgatggtctctaaaattccttcttctctttttgatcatatttccttcttcagactctcaaacagctttgcattaatttataaataaaagattttcacttacatagattagtaataaaaaataatgaaaataaactaagtaaagagccagcaggtggattagagaaggctgactgctgttataaacagtctaccatctcagtagctgaacacaataacattaattgtttcattcatgtcacaatttaatgtgaattgtacggaggctttgctccatgtagacttaaagactcagtttcttccatctagtggttctatcatctcttcctggaatcttccattggacctcctgtcttcagaagccacctccattcttaaaacagcttagcctagaggtggcaccactcacttccacatcatttccaatcacatcccattaaccattgcctcatctttcctagctgagaatttgatttaatgatgtgctcttgaaaataaagaacgtattagtgaacactagcaatctctaccataggaaagctactttgatttccaagaaaatggcatattgaaattagccctatctgtctcaaaaagctgtcatgaaaatcaagtaagtcaggaacgtgaaatacttttaaaattgttaagtgctgtgtaatgatatggcacactgacctacgcctccttttgataccttcacttctatacttccacaaaagattattttccagacttttaagaacccccaaattcataaattttcaaaaagaaacacagtttttaacatgtgtcaagagttactgtcaacttaatccacaagacaatagaataaacctaaatcaaaacatcaatgtttggcagtaaactaaattcactactcagttttgggttccattcatcacaccaggcttaacgccagtgtgattcaaatccaagctccaaagattagcaaaatgtatacagactgcatgtcctgacactctgaggtatgttattaaaaacagtcaaaattgtaaatggtaactctatgattgttaggcctatgtggtattatgcgccgggagttttggggatacttgctcgtgtcctttgcacctgaaggttgaaggtaagtttcacagttttttccactgtctctcagtccaccaccacaactcccacctatacttttcaagcagctctgtaaatcctgtctacttcctgaaaccttactcagttgagtagtggaacacctcatcttcttgtctcctatggacttgaaagaaactcccacacgggatcattcactttcctctcatgacaaacatatccttcttctccatgttgacgtacgccaatgaaaataaactgggatatcagagaaaacatggaaagaaactgtatcctagcaactcatggccaaatataggcattaaggtgcttaaattattagcattcactatgttttttcatttccctaaagtcttattctttgcaagcactttatcagtacttagaaaataaggtggttaagcttcctccaggagctcatattctacgaggggtgtacatcaatcaactgtccatattcgatgtaagtgacagaagtctgagaaatcgctctctggttacgaggaaatgtagcgtgttaatcaaggtaagtgagctgtttctacagagcaagtcctgaaactgctttgcatacatttgcatgttcattgctctgagaagtcccatagtaaaagcaaagcaaagctgagaaaacaacacctacacacacaaaacacttccacaacaaaacaagccaacagaacaacttgcgttgcttgaatgtatttttgtagggtgacttttttctctatagacttgttaatagccctcagattttcctaaatgctagattgagaagcactgaaagatgcagatgttttaataatttaaaagtagataatttttactttacaaaagcattggaaatctcaaaagaaaagtctgtgtcattaatattcaaatgcttgtacgtttaagtcttcttgtaaataatcaggtaaatctctgaatatcttacctagatgtgaaaacatgatttaacaatggatagtgatgggatgtattttaaataagagaatatatttaaatgcagagctaataaatttttaaatctgaatgaaataaataattttctgggaattatataaattacttcttttgcctcaagaaggaatgggagatatgaatagaaaatagccatgggagagaaattttaaaagttgtaattttttttttcatgtttagcaaaaggaagcagaatccatagaggtatccaatttagagaagcctctaaccccaaaacaaatgcatactgataacattcatacaaacaacacttctacaataaaagtctgatggaaaacatgatttgtaatcggtcccactgaaatagaaatgttcagggatttggtattttccatagaaaagttaaatgtataagaaaaatatgtttaggtaggatctaaacatgctcaccagcagaagataaaaatgacaaacaacaatacattttattcaggattaaaaacacttgttttctgcatatgccaaggaaacttacttgcttgtgcttagacatttttacccacattcagaaaatgaagcaaaattcacaaattcaattcataatttctttttaagctgcatataataaatacctattattcatgggtgttggcaaatctgtatactacctatttttttttctatgtttagccttcggagctgcttaaatcttaaaatatgtaccttctttgttgttctctttcttactgtggagccccatggcttggaactgtaagcactgctacagtcccaaacaattctttacttgacccaacaaacatatccgtcaaaatattttgggctatagataacagaacatcctactaaaagtggtttaaaaaataaggacatcattctgtcacataaaacctgagggagggtgatttattcagctactcaatagcagctcaatcgctcagtcttttcccatccgtctgtcccctctgcctttctcattgtgctggtttgtctccttagactggttcctctcatgatccctacaggcctgcagcagctctaaacaccacatacagaggaaatattcaagaacagaaaaggaaacatctttgtcttggtgccaatcttgtgagtaaataaacccttctcaaaaactccccagtgtatttgctctaaattttcattcaccaggattgaatcacatggccatgtttaagtgcatcacttagcaggaaactgagaccacttcacttttttcaaccagtaagatttgccacttaggagccagccccacccccgcacccccacccactggcatacacagcaggttactatagaatgagagtagataaaatctgggtcaatgttataggcaagcaagaaggaagcgtctaacaggcaaacaacaatgtctgtcaatagtctgtttatatgcccagacactatcagataccaatttatattccaaggagtcattctcattggtaggtaagttgcataaatgattatatataatttttgagtaagtgataaacattttattctattttctcatctatatatcaaagctactatagctgaacttcatagaatcacaaaattctaaggcagaagctcctagaaaattaataaactgatctatgataaatcaaatcatattttaaatttcctagggatgctccctacttaagaaagccttcaactgaagtttgctttcactttgttttagcatatccagttttcttaagttggaaattactgtaagtaaatgtgagagtggtacacgcacaatcatttgctttctctctattctcagattatcttgttggacttttaacccaaccacctgctccaaaccaaaatctagatcaaaataaatgttattgactccttaccctatataggatttctatttgattgctcagaaactccagtatgacacctgacataagagagtaaaagcacaacccaagaggcgctccagaaactggatcagcagagacatcttcagaggcagcagacctcagctgggttgaggaccaaacaccaccttcacgttatgtttttcaaggtaacaacacaacacaacagagagaagaggacacgggatgggaaaccaagagggctggcctctaccattcttgctttccaacagattttctgtggcaaggctctttcccttatcttgcagatgaaggagtaaatcatcttcagtgaaattcagctctctcccattaactcattgatttattcacttaactatcaaatgtttattgaacacctacttgcactaaactctacattaaattctagatgtgtggaggaaaacagttaaagtccctccagtcttggggtggggggacaagtaatcactgagcaatccagatgggacgtgttatgaattagataaacttggtgattagcagaaggaagtagaggagagaggtccatttagagtggtcaggaaaggcatcacagaagagggggcaggggagaaagatgagttaggttagacggagaaagaattacaagaacagggaagacaatggatgaaaatgtcaagagaattaaaatgtcgtgagctaacagggtctgacataagatgacggcagagaggaatgcagaagctaggtcaaccaacggccttgtaagccaagataaggagtttttacttcattccaagttaaattgatacattttaaatccacataaattgcttatgctgtagaaggttctgagaactgtaaaaaccgttccctttcttagtattcctgccagaattgtcgacaaacatcacagctacacagaggtgcacagaagaaagagatgataccttgaactttccaataacggtttcttcattttagttttctctttcttttaaaaaatcaaatgggttacaaaatgcttgcggaagcgtgagaacaacagtaacagtttctgcctagaagaatcctatttttgcttccactaaataagcacaagtctgttgtctagtatttggcttttggacaaaacataagagtcagaaaatcacgaccatggaactagggtcaaaattaagtagttgattggaaataaaagaataaatctaatttctgaggactgactatacgtagggaagggaaaagggagaaaagggcttttacattcccttcatgtaccatcctcagcttaatagccagagaaatctagaggcccaatgagatggatcatggggctctttaaatatattttaaagcattcttttcctggtggaattttcagattgtaagtttgttgttgatttgggattttttattatttatttatttttatgtactttttttttttttttttttttttgagacagaattttgccctgtcacctaggctggagtgcagtggtgtgatcttggctcactgcaatccccacctcccaggttcaagcaatgctcctgcctcagcctcctgagtagctggacttacaggtgcccgccaccacacccggctaattttcgtatttttagtagagatgagttttcaccatgttggccaggctagtctcgaactcctgacctcaagtaatccacctgccttggcctctcaaagtgctgggattacaggcatgagccaccacgcccaggcctggatttttttaaagacaggtgtgtatgtgtgggtgcgtgggtgtgtgtgtgtgtgtgtttggggaggagcacacacaattgtatgcaatgacattattggtgggaagaataaacaactgaagttatcaaaactttctaccagagcactggtaaatatgggttgtcatttaaataacatatccctaattttccatccactgccatagtgcagaaacaacttaattacaagtgtccatgggaggctctaaacttctgaggtcatggaaagtgtcattcacagtcctctgtagtctctgctatgattatcaccatgtccacagtaagcattcagtataaatttgtgaaactttattttatacaaacataaagctttatgtcattttccatttaaggcaaccagttttaaatacaacactcaaaaaatgaggatcaaagttgatgatgtagatattgtaaaatgcagagtactagcatactgaatgcatacttatgcactgaatacctactgtgtgatagatgtttattcagtgctttacttacactgtctctaactgctgtagcttttaagactatccatttttgaaaatgctggtgaaaatcaagaatcaaggacagcgaagacgacagttagtgatagtgtaaaaaacggtggctgtaggcatagttttaaatgttcttgagaaaggattactgttaactgcggaaatgtagcaagtgtatctcctatgattcatgttacaaatgtaaaggtggtgtacatttattaacaaatagctggatttaaaaattcttcagtcattttctgttgaaagttttatctacatctgtactttatcaaggcctatttagtttcctacaaaacaacaaaggatacgttttatctttaaactcaggaaggctgtatgaccacaggttcaaaatgcatcctgaggggattctacacctgccgcctcatggtgaaactgcctgaaaactgtctccagggagagcatacagaaatactccggcataatacagaaatcgccttttcgcaggaaactagatagcttgttaccaatctgtttggttggggataacgcatagcaatcctatcctttgtttttcctgatttttactgttcttaacatgcccaataaataccttctcactgttcaagaacaggagtgctgataaacatcatctcaaaactggcatctacacccataatattatattatataataatattagaagcactctccagccactgggcaaatccttcatgagaaaacagcatccatttgaagttgtgaattcttttcttctttaaggatggatttctcataccctaccagaatttttgttatcacaaaatgcacactcttttttcagaattcctgaataatgaaaaatacagaatttatgatcctttgagtaaatttctaacaagtgatgaaattccgatgaagtgtataatgattcctcattttctttatgaaatctatcagttcaactctttgccttgaggacagatgctaaacagttgctctggcaagttattaaatcaagtttctggtttcttgcagggcctttcaacatatccccacagaaagatgaggcagacaaagaaactctgtcaatacacctcatatcattaaaagtaaaaaagattaattcctgaaataatgtaaatacatggtatttttcatgataagcatttgaggacatttttcccccatatcccttaacaactagaattaaatccctctataatgactcatttagaatacatttatttaacaaaggaaaacaaagtaaactgactccattggacaagtttgaaaataattttatgaaaacatgttgaaattaaaaccaagtgtttctgatttgtgattctacttggttgggccagtaactttcatgaatataatttcatataccaatatgaatgcttaatgtactaaataaacaagttgtaaaaaattaattcttttctgaaatggtatccatcacattgcttcagtagaatctttattgaaaagaaaggccagtgcaacgcccaaaagaaaaaaaaaaaaagaacacattcatactccatggtaatattttgcacaattaggtagcattttacattaaaatctgcagaaagcctagcaagagtttcccattgtgataagggcaaaaactaaacatggccattttgtaggccctgattgatttaaccatttttttctctgtgtattttcaaatatcagtaatgctgagaacccaattccaacatttatgatggcggcattcttaaaatatgggacatacaatacaaaatcagcaatttctgaacagtggtacaactgccagtaatcaatggttttttaaattccttattatcccatgggccatttcaaatagtttgtattttccaaatttcactccctttttaatcaatgcatgtgacattctgctgctgtaaatcttaatggaaactatataatttgatcatcatactacaaaattactttcatttaagaaactatgctgccatcagtaaaaatgcatctaaattattatttactgaactgtagtaaaaccctcgaattccactaagaagagtagtcagcataaaggaatcaaaacagcttttccatttcagaactttcacaattgtcaaacaactgctttatcatcatgatgtacttaaattcatttctactattgaatatcaccctctacaaaaagtgttattcaattacgtggttccacagcacactggaggtcagctgttaatagcaaagatgtattatgatgtgcttttattatttctaaggagtgagaaaaataatacgttgtattacagaacctcagtcacagtcaatgttttcattcatttgtaaaaacaggcaattgaatccagaagcacacaaaagagaaaaaaatcttttcatggagagtaattaaagaaaactcttgactttaccatcactaagcagtgaacaaatccacacacacacaaatctgaagttgcattaatgcagacatacaactttcaaataccctttagccaatgtttgagttgctaaaacactagtaatattcattcaaggtgtcttgtcctttaaataccattgctcaccaacaatttaaattaaaaagaggaagcataaagtttgggaattttttcatgaaagtaaaatttttcctgtaatcccagcactttgggaggccgaggcaggcagatcacaaggtcaggagttcgagaccagcccgaccaacatggtgaatccccgtctctattaaaaatacaaaaattagccaggtgtggtgatgcgtgcctgtaatcccagctactcaggacgctgaggcaggagaatcacttgaacccgggaggtggaggttacagtgagccaagatcatgccactgtactccagcctggacgacaaagcaagactccatctcaaaaaaaagaaagttaaatttttattttagtgccataattcagggggaaaaaaaataagaatcttttccattgctctggggagaaacaaagtatccaaccatggaaaggtaaaagagtacatttaatatttcaactcaagtattataatgacagaaagtaaatttctctatgttaatgcataataatttcccagccgggctcagcggctcacgcctgtaatcccagcactttgggaggccgaggtgagcggatcacttgaggtcgggagctcgaaaccagcctgaccaacatggagaaaccccgtctctaccaaaaaaaaataaaattagccgggcgtggtggcacatgcctctaatccaaagctacttgggaggctgaggcaggagaatcactggaacctgggaggcggaggttgcagtgagctgagatcgcgccattgcactccagcctgggcaacaagcgtgaaactccgtctcaaataataataataataatttcccaaagattttgtgccatttgctacatactgctcttcctttgtcacccttggatgcccaattcttatgcaatgcattcccagccccaaattattttaatctccctgaatactctgatgtgtttaccacaatactatctcagttactgccaccattaaaaatagagtattccatataaaagtgagggtttgtttctctaaactatacctattttcatactttattgtaatctttattcttttctcaatgtattaaatgtcgttctgcttttttgaacaacagaatgatcatttcctgataaatcagggtttatttatactgtttaagtaaattcatttatacatttggctttagatctgatagaaggccttggcagaccactttattttttttaacgtgaggactctcaattactttgtgtcactttagtttgctctcctactttttgtagcttttgttctcatctactttcatagcttttaatttccctgtcagacggttgcttggatttttctggaatttatcagtgggtcagcagttggtctacgtttatataggacagaatggctgccagataaataagcattttagtgtgtaaagtaaaaaaaaaaaaaatgctctgagtgaggtttctgggcttttacttgaaataaagtactgtgcttatttggtgtgccttatcttctgtggtcttttttttatacttcttgcttctcagttggatcagcatagttgaggttcatggattcattcaacaaacatttactgattacctactacgtgagttcatgagaataaagaaacagtatccctgtcttcagaaagctccagttttgaagagataaaaataaagccaacaaggacagttgggagttttttgatagacatctgtaaaggagagctgcacaagaggttctccctgggtctttaagaaaagccacaatataagaggtgcaattttttgggtttcttttagacagagtcttgctatgtcgccccagctggagtgcagtggcacgatctcggctcactgcaacctcccgtgttcaagcgattctcctgcctcagcctccccagtagctgggattacaggcgcccgccactacgcccagcgaattttttgtatttttagtaaagacggggtttcaccatgttggccaggccagtctcaaactcctgatcttgtgattcgcccgcctcggcctcccaaagtgctgggattacaggcgtgagccactgcgcccggccataagatatacaatttagttcagcctaaaaacaagaggaaggaggacattttggggagagttagcactactgaatcaactggattgactggagaagtttgtattattcataaagacaatttccaattacataaagaattttaagcagttcaccataaaagggttccatcaaatcagcagaagagctggtcagataccaaattatgaaaaagtacttggggattataccaatagtgaatctggaaatctatttagacttcctctccagaccaaatatgcaggatggtaatagactattctttgaggagatcagcaggaaagtgaagaaatatgataaagtctagaagcctagaagtttaaagtgctctttttttgttaaatgagtacttatgatattacataaaaaatattctgctttgaattgtctgagttaaatgaatattcccagattcagaattctctgttccacttctcccttaaaaattattcctctttaccctttcagttccaccattccaccacctcagtctccctgatgtcattaatgtccctgctattaccaagtccaatggacatgttcagatccatcaacagcatttgagagcagctttcctccaaacctctatgcatgcggcctctaggacacaaccttccctggattttcctccaactctattgtttttctttctcttttctcctgtttcccctcgacttctcatcctcacctctattaattctattaactggggaacccaaagcttgggtcttgaaccctacggcattgttattctcttttttgttgattttgtctaatcccgtggctctgtcaccatttatatgctagcgacttccaagagaatatccccagcccagttttctgagttctggattcaagtatcaaattgcttatttggcatctccagaaggttatttaacagacagataaaattcaatatgtcccaaaccgagctcatgattctccattcaagccaaacaactctaccctcctccgagtgtttcttatcaataaatactacaatcaccccaacaggtgctcttaacacaaatctgggagtcatccttgacatttccttatatactcaccctcaatatatgaggaaataatttacttcctcttgtttattcaacctgcctacatatttctggcatccatccacttctctccaattccacagccaccataagagtaggggccagcattctctctcacctgatcaaccactcttcccttgatgaacactgagtttacagagcaggcaaagttcacactccacaccagagccagcaacgttgtgcagggttggctgccttcccccctcccactccatcctctgcatctccctacacactccctaaactccagccgaattggtttcctctcagtaatataatctcagtaggcatttctgaatgaatgacggaagaaaggaaggaaggagttacagggaaggaggaaagcagagtaggaaggaggatgggaagaaggaaaaaaaggaataggcttaaggtcattaaaaagaaaatctgttcctggaatcagaaaatctgagtttgagtcctagctcattacgtagagtatcatgaacttgaaaatggacttaatgtctcccttacaggggatgcattaaaggttaagtgaggtgatgtgtatgaaagttgtctgtacactatcaaagcactgtacaaacagaatatggaagcttaagacaggtaaaatacccgaggagcctatcacagagataatgcaatttagatggtaaaaagaaatgaggcgagcggatcacgaggtcaggagtcgaagaccagtctggccaaatctctactaaaaatacaaaaaaaaaaaaattagccgggtgtggtggtgtgtgcacctgtaatcccagctacttgggacgctgaggcaggagaatcatgtgaacccgggaggtggaggttgcagtgagccaagatcatgccattgcactctagcccgggcgatagagcaagactccttaaaaatataaaaaataaataaataaaaagaaataaaagaaagttcaatggctctcaatctttttctccctctattgtccacaagtcataactgtataaattcatcatatccatgtaaaacaggttataacacacttctatctgagcctctccttatattactgcaattttcaataagtttaaaaaaagggctcagtgttgaccactccctgacccaaggattttcaaatttgtgtaattctcacaagaaaaatgtattattcccttaatgagtatgatcactttcctaaatttttgttgttgttactgttgttttgttttttgagatggtctcacttgtcacccagactggagtgcagtggcaccatcttggctcactgcaacctccgcctctgggattctgtgattctcctgcctcagcctcccgagtagctgggattacaggcacctgctaccacgcccagctaatttctgtacctaaatttgttttgaaacaaaagtattctataattttaacaaatgcagaggagcacatacaagaaacaaattcccagaagttaaggtatcaagtaatactagttttggattttgaattatttcctgattacttgggaacatcattttccatttctaaaccaacatttccttgtctcttaaaattcataagaagcaacagcaaagaagacataaaagatatatctgcttcttaagttagacagcagttaaacacataacaaattgagaataaaaaataatttatcatattcacataaaatagttttaaaggaagcacatacatgtcttggtagaaaatgtctttataattatgtatcacatgtttattacttactagattaaaacagtagtaataataatctactgctgatatagtaaaggcaattccctaggtgtttcttttggtaatagcacctagcatttatatttgttaagtgtatttttccatgagcagagttctctgaaagctctatcaatagtaataaaaatggccaactgtgattcggagcatttagtcagcactgtatccatatgtgtaaattccaagccaggcattcatttcaactcaattctgctgcttcactactgctatcttgtcgaccagaaaagtacaggactcaaattctcccaaagaactgccagactcacttagtccaagcaaaggagaaaagaagccaattatgaattttattacttccacaattctcctcaagagaaacattataagaaagaacactgaattaaaaaaaaagaaaactgcctcgtttccaagggatcttgatcaaaccaagcttactacggaagttcttctgaaattagatataataggattttcagggaggtttgatatttatcccaaggtaaaacaacttcttaccgctttacctttcctttatttagtctgactcgaatattattgtagttattggattagagattcattttaaaaagcaacttttcagacttgaaatagctttatggaagcatctcacatttcagcagctaaagacaagtgttcatggttttgccaattcaattcactagaagccatctaagtctgcatggtctctcttttttttccttcccctactgtggctttgaagtttaaaaagaacttcatatatttaggaaacagagcgattatcccaaggctctgaacttgagcttaagaaaaaaaagcgctcatctcaggagcagagatgcgtgagcatatgccaggcaggaatgcatgtcagagtcctttgatggaaattcacagtctcagagatgtacccaagcaaagcacaacaaacaatgaaagctaattgccaagagtcagggttgtcttcataatgcattgcatctgcatagcttggcgtccagtgttaattaaccacagccaggttgggattgcttcctgatttcactgcagcatgcctctgaagcaacagcaatgtccacaggttagcattatcctcccgtgccactgtccccgctggacagcacaaaacaccacaaatgaagaggcgaatgaagaactgaaatggcagttcttatgggatcaaacagaaaagcactgagttttactattttattacttcctttagcagggatcagctccaatcaattaatgatttaattacctagactaattaagataatgaacaacagcaagcctacaatcaattagctttatccaaactttctattttgagtataggaccttaaggactatactctatgtctttgttgcagcaataaaatatgtgggtatattacggaactgccagggatgtggtcactcccaaccttaagcaaacatacaaggtcacttgaataattctttggtgacagaaggttgtgaaaggatgttacctggatgggcaatggatatttctccatcagaaatgcagatcttaaattgaattatgtctctcaaaagcaagtaatggaccaaagacaggaacatgcccttttggtcagccagcttctgtgatttgagttacttcagagtaaccatgtaaaaataaaaagcccctttcaaacatccagcagaaagtagcagtgtttcttgattacattgttcttgggacaaagtgttccttaaattacttagcatgggctaagaaattcatatatttcctaagaaagaagtacagacaagaagcaggcagttagggaggtgagtagtctaagttctagtttttcctttccatctgttacatctactttgaaatttaaggcttaatgatctgattccctaattatattgggtgttcctcacagagagaaaaggtctcctactattgggtttaaccatggccactactaaagtataatctattattgtctacaataaatatttttcaataaccttttcctcaagcaagaaaccatataatgcataccacagtgttcacatctgtcatctcccaggtaccacatctctcggcttacctatactggttgtgtattgtctctctcagaataaaaatgatcatagtgcaagtttccttgtatgtgccagcagtattgcactatgcttttaggggaacttcaaacttgcccatggataaaaggcattaagattttatacctcacaggctaagctagctctgcaccatgcaagaaaactgactcactttccaaatgccttctaaggcacctctgaaataaaggggaaatctcaatccaacaaaaatggatgccgtgtataaaatttatatctgttctttgttcagccaaccagttattgagagtataccatgtctcagccaatgtgcaaatagaacatagaaaaagttatttaatatcacctcatgtctgttagagtggttgttatcaaataacaaaaggtaggtgttggtgaggatgtggagaaaagggaacccatacacgctactggtggaaatgtaaattagtacagccattatagaaaacagtatggaagttccttaaatatgaaaaatgaagctacaggccaggtgcagtggctcacatctgtaatcctagcactttgggaggccgaggtgggcggatcacctagggtcaggagttcgagaccagcctgaccaacatggtgaaaccccgtctctaccaaaaaaatacaaaaaaaattagctgggcatggtggtgggcacctgtaatcccagctactcaggagactgaggcagaagaatcacttgaacttgggagtcggaagttgcagtgagcccagatcgcaccagtgcactccagcctgggtgacaagagcgagactctgtctcaaaaaaaaaaaaaaaaaaaaaaaaacagagctaccatgtgatccagcaatcccactactaggtctatatattcaaaggaaatgaaataggtatgtcaaagagatgtgtacattcccctgtttattgcagtaatactcacattagccaagatgtggaagcaacctaagtgtccatcaatggatgagtgaataaagaaaacgtcctattatgtacacagtgaaatcctactcagcctttaaaaaaagaatgaaatgctgtcatttgcaacaatatggatgagtctggagaccattatggcaagtgaagtaagccaggcacaaaaagacaaatactccatgatctcactcatatatgggatctgaaaaactgatttcatagaagtagaaagtggaatagtggctatcagaggctgggtagggggttgggaggggttggggagatgttggtcaaaggacgcaaaattttacttaagaggaataagttcaacagatctactgtacaacatggtgactacagaaaatgtgatactgcattcttcaaaaatgctaacagaggccaggcgcagtggctcgcacctgtaatgccagcactttgggaggctgaggtgggcggatcacgaggtcaggagatcgagaccatcctggctaacacagtgaaaccctgtctctactaaaaaatacaaaaaattagctgtgcctggtggcaggcacctgtagtcccagctactcgggaggctgaggcaggagaatggcatgaacccaggaggcagagcttgcagtgagccaagatcacatcactgcactccagcctgggagacagagtgagactccatctcaaaaaaaaaaaaaaaaagaaaaagaaaaagaaaaagaaaaatgctaacagaatggatgtaaagtgttctcataacaaaaattataattacatgaggtaacacattggctacttagccaaatttagtcattctacaacatatacattaaaatatccagttatattcagtaaatacatataatgttgtctgtcaatataaaaaaattaaaataaaaaagaaatcatttagatcctaatggaagagtcagtctacataaccaaatacaggaatcaaagaggaaaaaagtgactagagttataaaatatgtttggtgtgctaagggaaaggtaaatagggcatctttaagtgcaataaagatgggcaaatgaagataatagagagtgcctcaggaattaagcatgtgatctctgaagtcagacaacctaggtatgaatcacagcttattatttattatgaacaaacagcgaacaactacggacaaattacttaacccctccaaactacaatttaccctatcttaaagtctaggctaataagggttcttaaaacacatgattgttattaaataatctgcgtgaagcaaggtgcacgcacatcctaagtgcccaataaatattagctctttgttactaatattagaagcttttttcctggcaatagtggaccatatatgctcctggtaatgagctacaaccctttgcaagaaagcaaatttctgaaagacttggctctcttaaaggtctcagggtcaagtacattcagctcatgttcattagctaataacattcaaaaggtaaatcaagaggatattaaaaaataaggccatgcagggtggcttatgcctgtaatcctagcactctgggaagccaaggcggtgggtcacttgagcccatgagtttgagaccagcctgggcaacatggcaaaaccccgtctctacaaaaaatacaaaaattagcaaggaatggtggcaggcgcctatactcctagctactcaggaggctgaggtgggaggatcacctgagcccaacaggtcgaggctgaggttagcagtgattgtgccactgcactccagtctgggtgacagagtgagaccttgtctcaaaaaataaataaataaaaataacaataataataacagtaataggatatcaaaaatgtgccctttcataattataaatgagtttttatgtcagaattaacaattaacgattttatatcagaaataataattagtataatctaaatactttagataagtcttattaaaaagactttatttctgagaactttacatatgaagggccttcaaacatttagtgttcacagaattattctcaggatctccatcaaacgaataaaactagccttaaactttaggctgaaataaaaattcaccttggtaagcactttgattatcaaaatatattgctttcaagtaacatttctactaagtttgggaaattaatttaaactccatgtgttcttatgtaattaatgctagatgtgaaagtatcttactttattttaatgtcagatatccaaaatgtccaatttatagtaacatttaatgttatttcatgccataactcaacataattaattaactggttgttaaatatcattataaaacactgtaagaatcactaccaatatatatgtaagataataatatatttcatcagcaatataaaataattgtcttggtaattaaggaagctcatttagttctagtaatagtttattcaaacatataattatactgtatagctaacaagtacgccttttaatcaaatatataattattaaaatattcttgagggatataattggcatattataaatatatttctatcatgactacttaaacctcaataaatgtacctttaaaaaggccttgatttaattagcatacagtaactctctccttgaaatgaaattaagtccttaagaaaaacaactaatatgaagcataatcttatattactcaaattactaaaccttgccaagcaaaaataataataaaaacccttcgagagctcatttaccaaaaatacaaagatcacgtctccaagcaataattctcagcctgattgcccagcaggaccatgtagggagcttttatgaaatctattagcccagaccccatctacagagattctgattaggttggttgggaggtgggcccaggtatctgttggttttgctttttagaaagtccataaaccaccacaccagagactgataaaacgtatttctcccagcccataaatgtttattgtagcttcattcataatcaccaaatatttgaaacaacccaaaggaataaataaaactgtgatacggatataatgctacgcaagcaatgatctattgatttatgcaacaacatggatgaatcttaaatgcattctgctcagtgaaagaagccagacccaaaaggctacatattgcggcagtgtgagggaaattctgaagtgaaggaactgctacatgtaattgtagtaatgaatacataactatgcatctgtcaagactcatacaacagtacaacacaaagagtggattttactctatataaatttttttaaatcgaccaagaagtaggggagggagggagatgcaatgcagagtgtgacaaatgaaataactgtcttacaaatgtatcacataactatattgaaggagacagggatggagctgtccttagtaattttggtaaacagtcttttggctggatattgtaagagtaaagacagcctgtatcaacagtattttcttgttctgaatgaaaaagaagtcattatttattacaaatatttagcttactgtttatcaattgtgtgtctttaataatgaacaacactaaacaatcttaaaatctgaaaggttttgtaaaaactttttactggtgttattttcgtcactatgtgccttttttttttttctttttggaaagaagctgggcaggatgagcatgtaaaggcttcttcaaagtgtgaaagtggacagatactgcctccaggatccagaacaacagtcatttacaaagctagagacagaatgcactgaaaatacagcaattttacaggtagttccagcaggggataatttatctaatcaaacagctgatctcctacatattctactgtattcagtcttttcatgttaataaaatttgaatatgcaaagatcgtatcaattcttttttggggggtggggggcatggactttccctccttgttgcccaggctggagtgcagtggcacgatcttggctcactgcaacctccgcctcctgggttcaagtgattctcctgtctcagcctcccgagtagctggggccacaggcacccgccaccacgcctgactaatttttgtatttttagtagagacggggtttcaccatgttggccaggctggtctcaaactcctgacctcaggtgatccccctgcctcggcctcccaaagtgctgggattataggcgtgagccaccgcacccagcctgattctttaatatgttacaaatctcaaaataaaaatctcagaaatctaggtatgtgtgtgtgctttttatttataaaacagaatctgagaggattaaaaagacttaaaaacaacaacaacgataacaaaacacaacttctcctgcataactgtcagtgccagaatttcagggtcaaacatttgatctgaaatttggtatccagttcgctcctaaactgagtctccaattgtccacttaaaatctttatccactgagcttttgcgggtggcggcgagcgcggagaggacgccatgaaggcctcgggcacactaagagagtacaaagtagtgggtcgccgcctgcccactcccaaatgccacacaccgcccctctaccgcatgcgaatctttgcacctaatcgtgtcgtcgccaagtcccgcttctggtacttcgtatctcagttaaagaaaatgaagaagtcttcaggggagactgtctactgtggtcaggtgtttgagaagtccccgctgcgggtgaagaacttcgggatctggctgcgctgtgactcccggagcggcacccacaacatgtaccgggaataccgggacctgaccaccgcgggcgctgtcacccagtgctaccgagacatgggcgcccggcaccgcgcccgggcccactccattcagatcatgatggtggaagagatcgcggccagcaagtgacgccggcaggctgtcaagcagttccacgactgcaagatcaagttcccgctgccccaccgggtcctgcgccttcagcacaagccacgattcaccaccaagaggcccaacaccttcttctaggtgcagggccctcgcccgggtgcgccccaaataaactcaggaacgccccggtggaaaaaaaaaaaaatctttatccactgacgcataacttggaggaccatggtgagaattagtgaggcctgaccttggtacacagtgactcaatttcaggctttgaatcagttagtcctatcagaatgctacaagtcagagtatcctggcaagaaatttactattggccataataatgaataacggccctaattaaagcctaaggtggatcagatgagaagcgggtcacaaacctaaagagatgatctatataatctacttgttcttggacatccatcacttcaggagaaaatttttgtgtctcagttatcagtgccatcaagagcaatgattattttccatattgtaatcagagtaatcctaacaaagcacaaatataatcatctttacctttcccctttaacagcttattgggtttttttttgttttgttttgttttgttttatatcacggcctcctttattctgccctttgcagacactagtcatattcctttgagccttggcacaagcttttttttctgcctgttggctcttaaatcccaacatcactagcaaactcctaaatactcctgttgcttccaggaagcctgacctccagatagcttggtgcgcagtagaatacctccccattataggatctctgtacaaggtttttctcctaatcctttacattttctccattcattccccttgctattcctagaacctgctagtcaaggtcctgccctagggtctttggactggctgttttcctggcctggaatactcctccccatggctaacttccctacctccttcaaatctttgcttaaatgtcactttctcactgacctgactacccaattttaaatcacatctgaacccctacccacccccatcatgcaccctcctgatttcccttactctggtctttctcccaccataatacttaggtcacctttgaacacataatatactttcctatttatcaattgtattgtttattatattgtatttattgttcaatttcataatttagagccccctagaatgcgaccttaatggtgcaagatttttttttttgtctgtcttggtcactgttgtatctcaaaagcctagaataaaaagaatatctctgaaatgaatgagttgcttaaggacctatatacaagacattcaagaagaaagagagaaagctcacacttccaagacctgaacaatatctgtgagttaaaatgtgaatgcacaaaagatctatgaaaaaaaaaaatagctgctgtaaatttaaggtagcaaattagaaggtgtcatcaactaagctcagcagaaaaagcaaatcctacagctacatcgaccaattatgagcctctaatcgctgccaggacctcaaacacattatcccagttaattctcacacaacacataacaactgcaggatgaggttctcacacccatttcacagatgagcaacctaagattagcctggaagctacaggagtgcacagaccctacctgttcccatcttgccatcataccaccagcatccagcgatatgctggcgggcagtaggtgtagaatatatagaagctgcataaaattaaaaaatatatatgctcagagaggttaacaaacttgaccaagaccacttatccagtaaatagcaaaatacaggatttgaactcagatcattttatttaaaaaccaatgctcttcccaccacaccatatttcttctaactaaagttataaaacacatacggacctacaaaaatgcaacagtcaggccaacgatctaccacagtcattcctcagggcctcttaacagagaaaaatataaattgatattcctaattagtgtcacctcaataatcaagcagcaatcatgtttcatttgatctctttaatattgagacaggcaaagtacattctagagacaattacaacaaaatagataagtttaaagtttagcaccaaatgtttagccttcagacaattcaaaagtcattttcacagaaatagtacacagacattacagtatgagtaaattcctgcttctacttagctgctcacttgggcaatgccctttggagcactggcccttgaaatgctaattcactggctgaactactgttcacctgctctttagccttaacaggtctgtggcttcacattgggtagccacagcagtccctaagagaaaaaaggagctccagcaaccaagctatttaattgcgaaaaccgcaattacctttgcaccaacctaataacctaataacttgactccagaggatggatgaaaccaggagaagagagggggagcctctctccccacccttgggctaggagacacctaaggtctgtaaacctggcattgttagaacctacaaggagaaccaaaggatttaaatgaataattcatcatcccaaattcacattcactagaagtatctatgtaattgtggttaaagtacttcaaatgtgtccttctgcttcatattttagtgtaagatactaggtaatagaatccattctctaattcactttacacaaacagaatcagcccaaatgtttgctgccaattcttacatttcctattgttaagcacagaaatagctggaaactgctggtattgagaaattttattcatttcagttctacaaatttctagaggccctacacagagattgaaagcctatagtcgcagacgagatccatcccaaagatgtacttcctttagcctcaatattattgtaaaacctaggggatggttcacatataaacctagactttaagctgcactaggaaaatcaaaggatccggagcatgcactcccaaataggaagaagagaatgggtggtggcttccctcatgagatacaacacaaactttcgaaacagttgaactggcctacctcaataatgaatgttactctcctggtcactggctgtatggaaggcccagtattggaatgtagggggttgggggtgaggcagaatctgagatgaataaataaacttgtatgagaattgaaaattttaggctgggcactctgggaggctaaggggagcaaatagcttaagcccaagagttcaagaccagcctagacaacgtggcaaaaccccttgtctacaaaataatacaaaaaattaaccaggcatggtggcatgtgcctgtaatcccagctactggggaggctgatgtccttgagcccagaaggcaggggttgcacctgtaccccatcctgggtgacagagtgtgtcactgtctcaaaaaagaattaaagaaagaaaagttagacaaatacatctaaaagtaacatatgaaaactatgatacctctaggagagacacaaaaaccgtatcaatgtgcattaggtgtgttggggggagaagcagggatggaagagaaatacacaaagtgtatcctccccaacctacgtctcatcctctctggctgtcccttctatgactcatcaagcacttataaagtcaactcatcatgacatcctgcaaattccacctcttgaataagttttgtatagggtcctttggtatcccatattcaaaaatacagttcagatcctcaagaccctcattctatttgacttcacagcagtctcctaactggtcttccaccctccaacgcatcctccacatagctgccagtgacctattgaaaattcaagtcaggccacaacacttcccagtttaaaactttcactgggttccctagtaatttgtaatactcagcctcacttgagaataaactgaggggcattttttaaattagctatgcttgatcctcaccttcacatgtttttattaaattagttggtgtggggcctacatgtctacattctattccaagtgattctgatgttttatcaagttgagaatcaccgttttaccggacaagttccaagatcattagctttgccttaatgccctccacaatttctctgtctccggcacacctatgaacattccctgtaaattccaataaggaacccgctcctggtagcatcctgtgcatatatctacctcctgccctgaattccctttattataattatctttaccactagtctgacagcagtgacttgggtctatcttccttgtaactcaaatgcctgcaacatagtgagcactaaataagagtggatgaagacagcagaaaaagatggacctggaagaggaggtgagacctgaaaggcaaagctgtgaagtaagaaagggagaaggggagaatgcttgtaaagctggaaaatcagaaagcactttttgggctagcaaaatgttggtgatcataatttgtcaaagctttcttcaggctagaaaaagcaatctagtggcctgagtaaatacaccaaagggatttaagccaattattccctgcccagtaggggtgtcagattcatttgttaaactacaagctctctagagaaactagatctcagaacgcaagtaactgttttattataattatcataatacccctcgtttccctctcactccaaatcacaacaattgaaatgaaaaagaagtatgtgttgttcagttgctaaatagtctttttataaccttttctgatgtagtttggattatttcagaaatagtagttctccacagtggtttctgctgcttacatcaaatgagtcatgctgtggggctctcactctttcccctgagagtttacaccatagttgaatagacttaactattagtcattttccttcatattaagccaagagttttgtttaatctaattagtccgccttctctatacaattctaaacaacctcagtccttacaagaatataggtatgcccttcctacatctgcagaaacgtgtgcctcctatttactgccaggacaagctgaccatagttcgttcttaaattttcccacgtgagccagggattccaattctgaaccttctcattcccacctcccacaaaagcgtttcagtttgctggcacgatggagcgtagtgttatttccgagcgtttgctgctggatcaatggtgttttctcattagttttattttgcttttgatttataagcaccaaaatggtacagagtatatctacaccagaagcatctataatgtgatcaaattcaccatgacttttgtgcttttatttgcctttatgaaaccaatctcaggcttcgagacccatgattacaaactgtttcttcacagaccccttacaactttccaagcaaatgtaatactttccagcacttttttcctcttttttaagatgttcatagctccaaatgtcaggcacaccgtgcaatgaaaactatccctcagctgataaattattcatttttcaggagtttgcaatttgaaatggcactaacagctgaatacctgaagcacccccaaaagacatgaagagcaataacatgcaaagctttttctgcatacattttaaaggttaagcgccattagacatctatgtttatcaagagatgtgctccttgaacatatttcttctaattaatctgctcccaataaacattactaacaaagcaaagtgataaaggaggctaatcaaactaatctcttccctttaactaacttcatcaggttaaacaaggtcctttgctgatattctccactttctcctgtctgatgaggagttgcaggtgagtaaggtcaaaagcaggagtgatcaaactaggactcttgaacaatctggcccactgcacgtatttttaaataaagttttattggaatactgttttacccatttattttgtattggctgtggctactttcttgttacagtggcagagttgaatagctgtgatagagacccacaaagccaacaatatttaccatatagctctttacagaaaacatttgctgacctctggtcaaaaggcatgcaaaatgtataaggcttttaaaatgttagcgccaagtagggctttagctaatgtatatcaatgtgttcatttactctaaaaaaaagaaaaagaaaaaaaaaaaaccttgcatttaaaagtgtgttatctagaataccatctgtgttacagttccagaggaaactgcaggtctaagattgttcctcaagctggtagatgcttcattttgataacagtaatcaccatgtgtttcagctatttattgctgtgttaaaaaccccttcaaaaatggcttaaggcaaagatttctttgcacatgattcttccctccaggcctcagctagaagattttaaactccacctcccatgtggtcactcatatggcttatagtcatgaagaagaggctggactctggctggaatgccaagatggcttggctcttatatctagctcctcacctgggacagctgcaacaggtgtgggctggctgagtatttctccctctctgtggggtcccttcagcagggcagttgagcatcttgctatgatgactcaatatgtcagagagtgaaagtagaagcttccaggctgctgaagggccaggcccagagctggtgtactaccacttctgcaccctcctattactgatcaaagccagtcaggggactaacccacattcaaggagtggggaaacggactgcaccttgatgagaggaactgtaaaatattttggccatgatttccaatttaccacaccatgatgatgagtaaaaagtgacaacatgatcacaatgacaaaatcttgaaagcagaccttactgctgacaatttataatcaaattgacaaataagaacaagaaagcctaataaaagaatggaaatcattttatagtgaaacactagtcacacagaaatcaaaaatttccaaattgatgtgtttttttttaattgaaattagaagccattctaaaagccactcagtgcttctcaattcttacacagtgtgtaagctgtgactgtgacataactttcctccatgactctagggcctgaagatgactatcaatgaggggcatagtaactacaatgaacctggataactctggacctgatgcccactggcatctcttgggccctctggctgctgtgcattttgagctctcttgcctgctcttttcagctgttctgcctcttctctggacagggaatcatgagtgtgtgttttaggtccttccccatcacctattcacctttttgctctaggcaggtcatctactctgacccttggatttttttttttttttttaatctgagaagtgaggaggataaaaattatgttgcctacacttagaatattcaggaacaaatgagattaagaagataaagtgtttaaactggctgggcgtagtggctcacacctgttatcccaacactttgggaagccgaggcagggggatcatctgaggtcaggagttcgagactagcctgcccaacatggcaaaaaccccatccctactaataatgcaaaaattagtcaggcatggtggcacatgcctgtaatcctagctactcgagaggctgaggcacaagaatcgcttgaacctaggagtcagaggttgcagtgagccgagatcacaccactgcactccagtctggacgactgagtgagactccatttcaaaaaaaaaaaaaaaagaaagataaagtgtttaaatcattattcaagtattcaagtgaaaggtatcacaatcactgtggtaattaattaagataaaattaattttattgataaaaataaaatattaacaaaattaatataccataaaatagtttataataatggctaatgtttatttagcatttactatgtgcaaggcatagtactaaacaccttacattgcttaacctgcttttgtctttacagcaatcctataattatcatctaatactccagacaacaaaaactgagacataaagtgataaggcaatctgcttctggttttacagatattacacagaactacgatttctctttcccaattcgcacagctgatttcaagagcttgtgaaaggtctatcatatttctaacaaaatttctcccttccaaaccccatattaattagaagggcattatctatctctcctaacctctgctccaaccttctgttccaaagctttcacaagcaacatcagtggttctcaattgggtgattttgcccccctcaggggacagttctcaatgttgagagaccactgggttgtcacaactggactgtaagctgcttcctgagtagaattccttgataagaaaaatcatctcaataggtcaaaaatgttaaatagctgatttctccatacattaagtattactctgtgtgtgtgtgtgtgtgtgtgtgtgtgtgtgtgtgtgtgtgtacagagagaaagaacagaatgaaaactgaacctcacaggacttcacattcaggatctcatttaaacttcacaggagcctgtgagagctgtgagcattgccaaagggtcagaattctcctacctattctcaattatcctcccaggagaattgagaaaattgctcctggtaggcaagggagccattatttaaggcaaatctggttactaacaccatgtactattttagagaaaacatttaagttatggtttaataatcattttatgtattaccttacattcccattggtcttaaaataaatccaaatatgttaaatcatataaacaataaagggtttttttttttcttaaatggaagaagtttaccaggaaatattttattaaaaagctttaatctatatagggacttcaacaaatcacttaggaatcctattgctgtaattttgacaaaatggaagcatatagggaaaagccctattgaagttcctttcttccctgcaattctatgttgaccatcaccctccaataacagccttactttacaaatgtaccgtccttcactatctgcagctatggatattgatgaaggaaagtgtagacttaattgcatgtttccaatgtaaaactatcatctgctttaaaagaaaaataaaactgaccagagataacgagctaaaagcagacatttgtgcttttatttaccaaagtctttggtgttgcaagtctatatcggctggtgcaaagaaaatttcagttaagctgtttagacagtgagtttataacttgatcaggaggttgtatcaaaccttcaatgcactatttgtggaaaaatatatacacattttgtcctagtagagaacagtagtacctaattcaagtttaataaatagatgtcccaataatatatgtgtttccctacatactctcctatacctagcccagcaatccgaaccctttatacgacctccagggccccatgatgtgtctcctggaccttattttgtcctttgaacacactaggctccctccttgcactaaggtctttacactcattcccccatctgcctggatgctctgaactccattttttcatagctggacccttcccattcttcggctcaagtgttgtatctcactcagtaacaccttccttgacatatgacaaaccaaaccaagacctatcctctcccttcatatcctctcttactctcatattacatcatgctgttttacgatctttgcagcatttatcactctccaaagtcacgccgttcagtgacttgttgcccatagccatgtcttgctgcactgctcctttctccacaacatcccaactagaatataaagtctgtggtaacaggaatctggatctggcttattggaggcacactgtagtcatgcgctgaatgaaaagtattattacttttaaatgaaatgttactgaaatttgttttaaaagataagtatagatattagaggagtttctatcaacctaaaatcactgtagattaaaggtttaaatgacttttagtgacaaacaatggcattttatttttctctcactcctttataagcatcttaaaaaggtttaagtatatgtttctctatatatttatctttacacacaaaaaaactaagaaaacatacttggtttagtagatttgttatactttccgtatttttagcttaaaaggaatagattgtgtgctattttttaaactgacgatttaagtacttagtgtatcttaaagccacatttaataactgtagttactgtaaataactgccacagtactatgttgatttttgaaaacctattgcaaattgtacagtgaatttaaaacttttatgagagaacaaagctaaattgtaatgtcttttgtagtaaggcactgaacttcattgttttaaactgattctggattccacatttttaacagatattaacaaaaagataagtttagataaaactatctgaacttcatgattaaaaagtgaaattacaagactgagtaaagataaatttggggggaattttttaaatgccatgttaaaaacaaaggattacttataaggtactgaatacactttaggtcccttcttaacatggttttctccttcactctaaattttaacaatctgttggtggttcagttttagaataatgcttcttcacaaaggtcaattttaaaaaatgtttaagtgtcaagcagtctagcctccttaaacctctatcaccctggtcccttgtaccacatctactccgtaacttccaactagcctcttaacagatctcaaggccactctggctggcctccctccaaagaatttttccaccatgctgcctcattgctcttttaaagttgtaaatgtcttcctatagcagcttaaaaataagtcagtgattcctgcagttcatagaataaaaaccaagattttgaacaaggtttatggagccttgtcttacccagtctccaccacttagccaggctcatttatttttatcatgtctgtaatctcagcacgtcgggaggccaaggtgggtggagagcttgagcccaggattctgagaccagcctgggcaacatgaggaaaccccatctctaaaaaaaaaaaatacaaaaattagccggacgtgacggcacgtgccagtaatcccagctactagtgatgctgaagtgggaggatcacccgagcccaggaggcagaaggtgcagtgagccgagatcgcgtcactgcactccagcctggataacagagtgagaccctgtgtccaaaataaataataataatagctaaaaataagtgcatgtaaaaactggtaaaatctaaataacacatgtagtttagttaacagtactgtgcaaatgttaacttcctggttttgataatgtactgtcattatgtaatatattaatattaggaaaactgaatgaaagctacatggaaaattcctgtatgattgttgtaatgtcttttaagtgtaaaattatttcaaaatagaaaaaataaatcactccctcaggaaagctgtggattacttttcagaacagatgagccacttggctgcttattttcttccctttaatgcttgttactgttagaaaatgtaaattttaaaaattaatgttaaatatttggctatgccactagagtttaagctttttaggggcagggatcatattgcttttaatccacattttatcctcagtagttaactcaatgcttggcacgggaaatgtgtccaataaacatttattaatgggactgtgaaagacatgaatgagccaatcagtcaatgtcccttgaaatcataaatgtatataaatatacatatttacattttaaaaagattctgctcaaattgtgaagttaatgggataatatatgccaacagagatctaaacaaagatgcttctaatttggaaatgacacaaactaatgagaaaaaaaggcataatagcaactaacaacatttagtgaatatttaatcctattattcaaaatgctttacaaacagttatttccttagtccttgtgataactgtatcaagtgtgtgctatatttatcttcattttacagatgagagacacatagagatttgtaccctgtctgtggtcagagtaattatacagcagaagcaggacttgaacacaagcactctgctccagggtccacattctttatgcattacttactgccgagagacaaagtctgagaagattgcttgagagcatcctaaacactagctatgaattctgaagatagattacaggctggtgtaggcccacactgtttaaaatttttatattcccaccacttcacacagagctttccacatagcagacagacagacagacagacacacacacacacacacacacacacacacacacacacagtttagtgaagaaataagtgaagctaaagcaaactgaagaaaaaagaatatactaaattttaggttaaagaattggttctaaaatggtatctccatccaatcacaggacctttctctttaattcttcacttcatgatagaggctggcttggagtttctgaattaacaagaaacacatctacgtaggcaggaggggatggggctcccaaccaagtcaaggttacttgaaatgggtcaggtacagctgggtgtggtggctcacgactataatcccagcactttgggaagccaaggctggcagatcacttgagctcaggagttcgagaccagcctgggcaagatggtaaaaccatctctacaaaaaaatataaaaattagccaagaaggccgggtgtggtggctaacgcctataattccagcactttgggaggctgaggcaggtggatcccctgaagtcaggagttcgagaccagcctggccaacatggagaaactcggtctctactaaaaaaaaaaaaaaaaaaaatatatatatatatatatatatatatatatatatatatatatatatatatatatatatatatgacagccaggtgtggtggtgggcacctgtaatcccagctacttgggaggctaaggcaggagaattgcttgaacccaggagatggagtttgcagtgagccaacatggtgccactgcactccagcctcggtgacagagtgagactccatctcaagaaaaaaaaaaaaaaaagattagctaagcatggtggcgcgtgcctgtagttccagctactagggaggctgaggtgagaggatgacttgagcccaggaagtggaggttgcagtgagcggagactgtgccactgcactactccagcctgggcagcagagccagaccctgtctcaaaaaagaaagggaaaagaaaaagaagtagatcaggtacatagaaacagaatgagaggaaaattaaagaagttaagaatgttaagggaataaaaccaggagatcacacaacagtagaatcaaataccaccagactattacaaataataagaattagttcacaaatactgttgataattgttccatccttagagtttagggcctattcccaaatagagataacaaacaggtcacactttggaattgtttaaaaaagcaagtcctactatactcaataaaaaatgctttgaaatgtacacgtgttgattttgtgacagagtcttaatcttactaggtagctacagctctgctgggagcaattaattcaaaaagccacagaaactccacaatgaggctaaaggatcagtaaaatagctggaatactttccttgcttcagacagctggatgctgctaatttagctactttaaagtgaggggaggaaggaagagggagtaattttgccacacctctactaatttagagaaaagagaaacaatgaaggctgataaacatggctacgtgtttatcatgtaaacatacaggttactttcagattgcatatactaaagggactctaaccaaagaactagggtaagcagaaattgctttttgttttggtttaggtgttttttgtttgtttgtttgtttgtttgtttgttttgagacagagtctctctctgtcacacggctgcagtgcagtgatgtcatcctaggtcactatggccttaaactgggctcaagcaatcctccctcttcaacctcccaagtagctaggactacagatatgtgccaccacaactggctgttttttttccttgttttaacagctttagtgagatataattcaaataccataaagttctcccatttaaagtatacaattcaatggtatttagtatattatgtttatactcagtaccaacactctaatctaacttaagaacatttttgaggccaggcgcagtggctcatgcctgtaatcccagcaatttgggaggccacggcgggcggatcacctgaggtcgggagttcgagaccagcctgaccaatatggagaaaccctgtctctactaaaaacacaaaaaaattagccaggtgtggtggcacacgcctgtaatcccagctactagagaggctgacgcaggagaatcgcttgaaccgaggaggcggaggttgcgatgagccaagatcgtgccattgcaccccagcctgggtaacaagagcaaaactccatctcgaaaaaaaagaacattttcatcatcccaagcaatttatcttttaaaggatacttaaatgatagagataacactcataatctaaaacaaaaacaaaaagacatttttattttactttctaagaatttttgtgcagatgaggtcttgctatgttgtccaggctgatcttgaactcctgtcctcaaatgatcctcctgcctcagtctcccaatgtgctggaattacaggcgtgagccaccacacatggcaaaaaccaaaatctttttaataagatatgtttctggtgtaaactgactctgcctactgaaatgtatgcattttaataatataagaaagttatcctttcctttcctaacttttttgggaagatctcgccaatttctgcaagatgcaatcatttgccctgctttcaacatcatcattttcctattcctttaaaaaaatgtttttggctggcacggcggctcacacctgtaataccagcactttaggaggctgaggcaagtggatgatttgaggttcgaagttcgagaccagcctggccaacatggtgaaaccccgtatttattaaaaacacaaaaattagccgggcatggtggcaggggcctgtaatcccagctactcgggaggctgaggcaagaggattgctggaaccccagaggtggaggttgcagtgagccaagatcacaccactgcactccagcctgggcaacagagtgagactgtctcaaaaaaactaaaaaatgtatttttttcctgcaagataattcctggtcatatcaatggccactcactctctttctcaccaagctcaccccctaccttcagctttctgaagaggcactgtattactgtgtttacctacagtaaatttctatagttccttcctgtgagctgctcaataaaatgtatgtaagaggcaaccgtacaaacagaggaaacgccttctactatccattctacccaagccaaattaattttaaatgtgtaattctaagaagcctttttttaaccactttagactaaagtagatatgcttcatatttcccctcttgatcttcaatttaatgcccggaagcaagggtttataagaactcctacatataggactttgcagagaagcaagctggagactttaacttgctacaagaaaacctggcttatccaccacccaaattttgataacctctaggtcaaattaaaaaaaaaaattagcacagtgcttcacacgtgctcaataaaactgtttgctaaatcttgttgaataatgatataataacagctaacattcacgaaacacctaccttgtgttatctgctaatctatgagttttcttttaattcagcaaatcctcgcaaaacccaggagtattatatcatgaccatcaccgtcatccacattttaaaaataggaaaactgaagcaaagagcaagattgatcaaaatgacaaagatatgggaaactgaggctaaaagcatgatttaccaaatcacagccagacttcaaaaccagactatggcttcagagctcacattcttaaccactactctatgctgcccatcaggaaatacttaagatagcaaatgattatcttacaacacagatgtcagtctatgctctaatgtcaaagaaataaagaaactccatggtctacagtgatataataccaaaggggtttgaggagggactcactgcttccataaaagacagaaatattgtgagtataggccgggcgtggtggctcacgcctgtaatcccagcactttgggaggccaagatgggtggatcacgaggtgaggagatcaagaccatcctggctaacacagtgaaaccccgtctctactaaatatacagaaaattagccgggcgaggtggcgggcacctgtagtcccagctactccggaggctgagacaggagaatggcgtgaacccaggaggcggagcttgcactgagccgagatcgcgccactgcactccagcctaggcgactgagcgagactctgtctcaaaaaaagaaaaaaaaagaaagaaatattgcgagtatatagtgactacagcaaggctctttaacaataaggaaggagaatgaagaagtattcacaatctgaagtggaaaaatgacaaaaagcaacaagtaaatggatgaactaaaccatctgaggaattaaattatgaagagtgtgtctctacaatttaaaaaaaatgttctatttctgagatcaggtaaacattcaggtttaattataatgaccacagtgtaaactcaggtctagaatgtaacagtatgctacaagtgatttcgttagagtgaaactggtctgacaaagaagatgctaacagtaggttcttggtctgcatttagtttttcttttttaaagactggtaaatagcaaacgaaatttatgtatgaaatacaactaacagaagctattatgaaaactcatccagaagaaaaacattcacctgaggattacattactataatctatatgaatctttaatctgcatgcatcttacagccgaatggttctcggagcactacctaaaccacaaaactggttggccagccctgaagaagagcttactcatgctgctcgaacagaagtcgcatatgcccttccctgagatcacagctctactgtccagacatgcattcaagaaacaacaagcaaaatcatctgggccattcaagacaccggaatgaacagaaatcagatacaaacacacgtctagctttttcaaataatagtggatatacaaggcattttaaactggcaatggcaaagactataattttctgctgagggatattatcacaattttccaacctaggtttgaaccaaggcttataagagccctcctccttaatgcaacatcacacccagtactttgctatgacattctatacagcagattataaccctgactctcaggctttttggagttaatcatttcaaaagagagtgagttggacacattaaattaacatggcaaactagagtggtttctttccattcccatccccatatggtcttctttttcaaaggaggacaaacatttgaaaaaattatttcagagttctaaaatgactctgacaagctactattaataactcttgatcctttggatcaatacgaaacacagttaggtaaaagggaaaacaaagaaggctagatgtgctaatgaaggcataagaaaacaaatcagtgacccaggcaataaaagcctgaaaaatattatctttatatatgatagtgaataaatcaaatttttctgtagtgttacttataactttatttttatttcagtgtttgaagaaaaggtaatgacagtatttgataagttataatctggatcctattttaccaattgtttttaaacatttttagtgactaaaatgatatctccgactctaccatgtgctttcacaaaccacaggtatcttctggtagattgcaaatggatgtcccttcttcttttaaaatgtaccttaaaagatatggttaaattttcctctttcgtcaataactttcagaatacacatgctattcaagagtgccaaatgaatctgtgaaaaggaaaatatactacatggaggctgattagacaaggacaaagctaatcaaaattgatttggccaagttgaagcctgcttcctctttttagctataatgggaggagtgagagggagtagattctttttcaagggacatcttaaggttgaaagctggtatcacaaaacatacagcatgataaatatcttaactaaaaattgctaacaagggcctttgtgatttcttttgtaagactacacagcataagaagtgtgatgaagaagaacgagaggaagatggaggagaaaaccagtaagatgacggttatctgcagaaaagattgttttttcaaacacaattttaaaagtcttcctttctaaactccacatctgtctgccacttttcaccagagaattaagcaaaggcatcactcctcagtagaagaacatttttagttatctggaaatataacttcatggacgtacaataattatatctagtaactttaagaaaaactctagctgtgatctgacattaaactgggctcccagggtctaaatgggcttttgccaaaaattaacaatggtgaaacaacttacttttgcactctagccaaacaaaaataataaaaccatagtctcaatttctctttaataaactaaatttagattacacctttaaaataagctttgacataaatggctttaaaataacaagaacatctaacatttgggtcttttcccagttaattatttgctggcattagactcgaaattccttggcttcaccttaagttgacactcccaagtgctaattaggaaactatatacattattaaccagagaatgttgtgcttaaaacatgcatattacatatgtatcttcttattaatgttattcctttcacttctcaaaatacctctttagaaaatagagctcctatttccatgaagcaattggtggctcgtgagggaattcctgtcaaaatgcaattaatagaaaggggccaagatgacacaggatacttgtcttggaaacatccttaacatgagtcaaatttaatctcactgaaatagtggagagaaatgttaatgactgcagatgtcacacattttactcatactaggtgattcccaaagaaaatggctaactcatgtatgaactaaaccactaccaaggaaccacacatgtcagggagtacaaggccgagacatgcctttctccaatactatctcttccaaaaagccacaggacagatgggaaaataaatgcaggtaaacaaggtagacctaatgatttcctaattaggaagatgtgatcttctcattaattgtcaagttaatggaccacaatagcagtttcataaattgagtccagtaatccaagctttggtgtctctagtccacagaattctcctcatacttccagacccttcatccagccacaaagttgtcagttctgcttgatttgtttcaatactgtactcgacgacagctgtcggaaacagtacattagaacagctgctatgacagctacaaggggcttggaagtttaattaggctcattgtgacattgtgcatttttctaaacacggaatgatccacaaaaataaagaaattttgagtgggtctgaacaatgtttacttattggcaccaccaactggttaacctcagtttgagttatatccttggtctcataatatctttgctaccaggctgataagaggtataaaaaaataaataaacaggaggagcagttagatgcacaagaaaaggggcattaaaacggagaggaaatggtgaggaagtcacgtcaataatctctttcaaaggctggctggtagccaaggaggatcccgcagtgtctcaggatttacttccaaaggaaatgtattcagaggccctgagcctggtgccaactgcaaacaaaaccactcattatggtcacagccccctagagaaggggagaatggcttactctcagcatccgtgcggaggaagaaagtgaggagcagcagcagcagcctggctacgtgcaccatcctgcagcttggcagcagcgtgcgcgagcagcttggaatcactgcctccggagccgcagcgagtctgtccgatctgaaatttcagctggaacactttcagagc
